United States Patent 10,724,096 (METHODS AND COMPOSITIONS FOR INHIBITING AND TREATING NEUROLOGICAL CONDITIONS) - sequence listing, part 142

SEQ ID NO: 2600 - DNA, 758004 bp, Homo sapiens
agatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcgg

SEQ ID NO: 2601 - DNA, 81907 bp, Homo sapiens
ccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattcaaacccatttctacttgttgcaaaaacttatcctttttattgctaccctttgctacctccctttaagaagttgctcggcgtggtggctcacgcctgtaatcccagcactttgggaggccgaggcgggcagatcacgaggtcaggagatctaaaccatcctggctaacacggtgaaaccccatctctactaaaaaataccaaaaattagctgggcaaggtggcgggcgcctgtagtcccagctactcgggaggctgaggcaggagaatggtgtgaacccgggaggcggagcttgcagtgagccgagatcgcgccactgtgctccagcctgggtgacagagcgaaactccgtctcaaaaaaaaaaaaaaagttgcaagtaatttgcaaacacatttattagtggtattatggtcaaattataaatttgaagagaaccgagtttgttcctttaatcttagtaaaccagaccagtactacttttcttacatttaaaatgatgaatgtgttactgaggttcatcatgtaaaaatatttacttaatacaccatgtctttttttgtttgtttgtttttgagatggagttttgctcttgttgcccaggctggagtgcaatggcgtgatctcaggtaaccgcagcctccgcctcccgggttcaagcaattctcttgcctcagcctcccgagtagctgggattacaggcatgtgccaccacgcccagctaattttgtgtttttaatagagacggggtttctccatgttggtcaggctggtttcgaattcccgacctcaggtgatccgcccacctcggcctcccaaagtgctgggactacaggcgtgagccactgtgcctggccccatacaccatgccttaaatgtgctgaaaataatttttgtaacttcattttaatgtaaaagtttaataaagttcagaatatcttttaaacctttgaaaatgactttgttgattttaatgaggactaagtgatttattcatattcacatgcttttgaataatccctgttatgtataaggattctttactaaatattttgggtatttcctctacctaaagacactattatgcaacagacagaatttccatttgaaagggttagaatattgctgtattacacatattcatatgtcccttcttttccttcctatacaaagtgttgttttgaatttttaacaatttatttttcttcatctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatacta

SEQ ID NO: 2602 - DNA, 102247 bp, Homo sapiens
ccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaaactatatgtaattgttttaatgtgttacaccatcatgggaattgatcctaacataggcattttctttacttcttaaaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcaggtactctggtaaacccttcactttcagcctcacgaaaattcccctagcagtgtttggaatgatctaaaatgctgtcttggctgggcgcagtggctcatgcctgtaatcccagcattttgggaggctgaggtgggtggatggcttgagctcaggagttcaagaccagcctgggcaacatggcgaaaccccatctctacaaaatatacaaaaattagccgggcatggtggtgcacacctgtagtcccagctacttgggaggccaaggtgggacgatcactcaagcctgggaggcaaaggttgcattgagctgacattgcaccactgcactccagcctgggagacagagtgagagaacctgtctctaaatacataaataaatataaaaataaaaaataaaatgcaatctctgtaaaattgactgtgtcccactcatcactggtgagcccgggggagggtgaccctcgtgggatatttggcatattactaattgatggccacatcttggccttggctaatccatagtttaaacaatggttcactttttaaatcagtgataaagctgtgtaagagtttgataagcatctaccaggcaccaaagaccctgctggacatgggtaaacagagattacttggcagaatatgcccgtaagagagcccctgcagaacaggagcaacggttctatcgataagtaagtgtggaattttgtgttcagtgttagagtaaacatatgttaaagattcagcagcacaaaatgagtgattcattctgccctgtggacacttgggaacagaaggcgactcttgagctgggttttccaggcttattaggcgctcagtgggttaacagaatgagctggtccaggaagagatcagcctgtgaaagccgtggctgggatattattggagatgaagatgttaaaagaggaggtgagattgaatagctggtgacattgagactttatttttagggactgggaatttttaattctaagagtgcctgaatcacatttgcattttagaagaagaactcttttgaggattgagagggtgtagatgttagaggatggagaggctggagactggggagcctttaggccggtggtgaggaaacttttttttttacataagagctaattcagaagaaattaagatatttgagctgcatcttattttttattgtattgtattgtatttatttatttatttagagacagagtctcactctgttgcccaggctggagtgcagcggcatgatctcagctcactgtaatctccacctcccagattcaagccattctcctgccttagcctcctgagtagctggaattacaggcacacaccaccacgcctggctaatttttgtattttagtagagatggggtttcaccatgttggccaggctggtttcaaactcctgacctcaagtgatccacccgcctcggccttccaaagtgctaggattaacaggcgcgagccgctgcacccagcctgcattttatttttacataaaatgaaattaactggtacatgggaatggagaaagtgatttacttttgtaatgagaagtgaataatttttaatttttaacccatttagaaaaaaaaatagtgcagctggctgcaagtgcccagctttacataaacatgctctttgaggctgaagcaaatttgactaattgtcaatgtgaaaataaaatagaaaaactgttcttggagttatttctaaacagaatttgtctctaatcctaatgtaacaaaaacggatatgatgttacattaggatcagagacaagagtattctcagggcaaacagaaaatgggataaaaagtaaagtaggcagggcacagtggctcatacctataatcccagcactttgggaggccgaggtgggtggatcatgtgaggtcagaagttcaagaccagcctggccaacacagtgaaacctcatctcttctaaaaatatacacacacaaaaaaattaaccaggcatggtggcacgcgcctgtagtcccagctactcgagaggctgaggcagaagaattgcttgaacccaggaggcggaggttgcagtgggcggagatcgcaccactgcactccagcctgggtgacagagtgagactctgtctcaaaaaaaaagggaaaatagggccaggcgcggtagctcatacctgtaatgcagcactctgggaggtcgaggcaggcagattgcttgagcccaggagttcaagtctagcctaggcaacatcatgaaaccttgtctctacaaaaaaaaaaaaaatgtagccaggcacggtggcgtgcgcctgtaatcccagctactcaggacgctaaggtgggaggattgcatgagcccaggagtttgaggctgcaatgagccgtgattccatcactgcactccagcctgggtaacagaggaagaccccatctaaaaatagacaaacaaaaagttcaataggttttgtcccaattcaggaaaatgtatacttttacaaatttgtattatctcctttacgaacttgaagaatgcctttgaggaaatgtatactcctggcctctaagctgtcacgaactcaccattgttgagtagcaccaacatcaaggcagctttctaatcactcagctttcactgcatttgaacagtggattgcacggcaatcttttctctcctgggaaagaaggttagagaatacggtggtggtttaaaagtatgggctttggccctaccacaagctaagtggcttttggtttctcctgttgtaaagtaatagaggattaaatgggataatgcatgtaaaagcacttaacatatgtttgacgtacagtaaaagccaaagaaatattaaacatttaaactctattcctactgtcactaattcagagattgctcattggaaatcaagtctggggatcagcaaagaaatactgatgccattagaaagctgagacgtcagggtgacaagattcggttgatggctgcctcctcagcccaagaagacagaatatcctgtcacctcccaagggacacacaaatcagggagggatggagatatattttattcattttagtaattcccagcacatcacatggtatatttcacctagatttgccagttgttgacatttttatcaaatttttgctctgttttttagctggggctataggcatgtgccactgcgcccagctaatttttgtatttttagtagagatggggtttcaccatgttgcccgggctggtctttaactcctgatctcaggtgatccacccgccttgacctcccaaagtgctgggattacaggcgtgagccaccacgcctggcctttttgctcttgctctctctcgtgcacacacacgtattttttccattgaaacagttgaaagtaatttgcattatgacacttcacccctaaatatttgtacataaatctcccaagaagaaggatactctcctacataacatacaaggccattatcaaccccaagaaatgagtcactgatgcaataaaattatttaatatacaatccatattcaaatttcccccaagtagttccacaaatgttctgtgcaactgttttcccccagtgcaggattcagtgcaggatggcatattgcattcaactgtcagtattctttagtctcctgtaatccagaatgctcccagcctttctatctgtatcagtctttctccgcccctttctttctttcacactgacatttatgaacagtctaagaattcatgtagaatgtcccataatcaggatttgtctaattatttctttctttttttttttttttttttttttttgagatggggtcttgctctgtcacccaggctggagtgcagtggcgtgatcttggcccactgtaacctccacctcccgggttcaagcaattctcctgcctcagcctcctgagtagctgggactacaggcccgtgccaccacgcccagctaatttttgtatttttagtagagacaaggtttcaccatgttggccaggagggtctcgatctcttgacctcacgatccgcccgcctcggcctcccaaagtgctgggattacaggtgtgagccactgcgcccggcctaattatttctttaagatttgattcaggttaaacattctgggcaagaatttacttaggtaacattccatacccaattctctcttgaactgattctaatctggtttttgttcccaccactcccccaaaattgcactgtaaaagtcaccagtgatttccatgttgttaaatccggtggtcagacctcagttttcatctcactggagctattggaaacgtcaagttgatcacatactctgttttgaagcgttttgtttatttgcctttgggagctcttttcttggcttttacctcttacatcacttggccatgccttctccggctcattttctgagttcccatattttccttttttttttttcccactctgtcaccaggctggagtgcagtggcatcatcacggctcactgcagcctccacctcacgggttcaagtagtcttcctgcctcagcttctcaagtggctgggactgcaggcgcatgccaccgtgcccagctaatttttttatttttttgtagagacggggtttcaccatgttgcccaggctggtctcgaattcctggcctcaagtgatcttcccaccttggtgtcccaaagtgttgggatttcaggcatgagccactgcacccagccctaatttttaaacactgggatgcgtcagagttcagttcttgaatctcttctcattctgaattcacttcctggtgttttcatccaatcctgtaggtttgtccttttttttttttttttttttttttgagacggagtctcactgtgtcgcccaggctggagtgcagtggcacaatcttggctcactacaacctccgcttcccgagttcaggtgatctcctgtctcagctccacaagtagctgggattacaggcacgtgccaccacacctggctaatttttaaatttttagcagagacggggtttcatcatgttggccaggctggtctcaaactcctgacctcaggtggtccgcccgcctcagcctcccaaagtgctgggattacaggtgtgagccactgtgcccggcctgtcctatttcttttctgaactccagacttaactatccagcaactcaagatgtctcatgggcatttcaaacttaagatgtacaaactcaaactttgattttctcccgtatctgctgctttcctagtcttacctctcttgttaaatgccaacttcgtccctctagttgctgagaccaaatgccttgaagtgatactttatttacttttccctgcatccaaatccaatccaacagcaagtcctgcagatctacttcaaaatatacccagaacttcttacctctttcactgctaccatttccgtacaggataccatcaaatctcacccagattcttgcaataaatttctcactatagagacttttctgccttcactctcccttccacttagtgctttctctctacatgaccgtcactgtgatgcagataaaacataagtcagatcttgtcactccactgtgcaaagccctccgatggcttcccttctcatttagaataaaagccaaaatccttaccgtggcctacaaggccctacatgatcttgtcctgttagcctcctggatcttcattgctaaaattctccttaactcactcctttccaggttcactggccttctgacagcttctcagatataccaaggatgttcccacttcaggtcctctggtatctcctatctactccttctcaggaagccactaggtgatgtgctccagcaaaacaagggagtaaaccaagaaacaggaaggtgtgagatacaggaaactgggaatcctactcaggacagaggtgaagggaatctaagcaaagggagattttaagatgacagctgtatgccaggaaggagagggtaaccagtcctgtttcgagtggatcacaagagtctggggagaggcttttctatcattttcctgtttgtagaagtatttgactccttaaagcatagacatgtaaaatttggatgaaaataagaactaaaagaagacataattcaggcataaggtaatgaaagcatctaggctaaagtggtgacagtggaaatggagagggatggatgtgagatctttggaaggaagaataactaggacttggtatagattgttgtattagtcagggttctcttagagggacagaactcataggatatttatatatatcctatatatatttatatatataaaggggagtttattaagtattaactcgcatgatcacaaagtcccacaataggctgtctgcaagctgaggagcaaggagagccgagctaagtcccaaaactgaagaatttggagtctgatggtcgagggcaggaaacatccagcacgcgagaaagatgtgggctgggaggctaggcctgtctctctttttcatgtttttctgcctgctttatattccctggcagctgattagatggtgtccaccagtttaaaagggggtctgccttccccagcccactgactcaaatgttgatctcttttggcaacaccctcacagacacacccaggatcaatactttgtatccttcaatccaatcacgttgacactcagtattaaccatcacaattgtaaaaagagaataaaggagaaatcagagatgactgtaggaccattaacagaaataaggtattcgagtgtgagaactaattttaggaaaattgtgatttaaaaagtgatatataatatatagaataatatgtgctaaaggccaatggaaatacgacaacatatacttgtattttgagctcgtggaactcttaaaagttctgttttaaagttcttgttcttaggtatgagtggtcttttttacactgacttagttaatatgactacagattagctttaaatgtttaactgaagtcatatgcttggcaggtttcatatagaaaatcgggccctcccttgggcctcttttgtaagggcactaatcccattcatgagggcagagcccccgtgacctaatcacctcccagatacccccttcttcacactatcccctgggaactcggtttcaacatatgaatttgtgagggggacacaaagattgaggccatggcccttcacagtgtctttttttagagcgttcctgattggtaaaaggataaccaggatcaccttacacctgttgccttcccagcagttttcacctttttcacatgattccactcagcatcttgcaattcattccaaatcagactcaaaaaccattttaagcacttactgtagtgtgctgggcattatgctagatacatagtctctctgttttttttatttgtatttatttatttattttcatttgcttcctgtacctgggcagcaaacacaatctctctttcaatccttatggcagccttgttttatacagctgcaggtattactgtccctgttttaagataagaaagttgaggcttgagatgcgaaatgacgtgtccagggccacacagctggtaagtggcagggcttggactaaaacacaggccattcacctccaaccccatgttctttctgctctactgggctagctttcagatttagaaatatgctttaaaaaaaagtcacatcttctcttcctgctagacttgcaagggggagatttttaaaggggaaatactttgtatatttatttctcaagatgactttttacctggaaattttacttttgaggcactgggtttcataaccttctctgcatagttactttatggtattagaactgctacagaagcctgcaagctaatttctgcagtgccaggaaatctggtgacataatagttatggaccccatcaaaactcctcaaataagagctatttataagtaaccatgtgccaattttgcacaaatgcaaaaaggcaggaaaaatggctttgaagagccagacattttattttaatgggcaacctgaaactatatctcataccatatatagaaaggaaactgtgcaataccatagatgttttcactggaagtttgtacttgaaatttttttttctttgtttttttgagacagagtttcacactgtcacccaggctggaatgcagtggcgcaatttcggctcactgcaacctctacctcccaggttcaagtgattcttctgcctcagcctcccaagtagctgggaatacaggtgcacaccaccacacccagctaatttttgtgtttttagtagagacagtatttcgccatgttggccaagctggtgtcgaactcctgaactcaaattatctgcctgcttcggtctctcaaagtgctgggattataagcatgagctgccatgcccggctctgcagttgaaatgtcatcattgatttcaattaggtgtaaccccctcatatgctggaacctgctagtactgacatatgagaaccatgtttactgacgtccatcacattggtagcttgacatcggccatggtgggagtattgacaccactgaaatgagcaaacactgcaagttggggctctccccaacactctggagacgactgttaaatattagcacactgctggttacaccattatatgaaattctcattttgtaagctaaagaaatggttgaagattggcagtttgacttggttcatactacttttaaaacatattattagaacaataagctggtaaaagataaccagattcttaaaaatcagtttgtcccttgcaaaatctttaatataacataaatatggaatcaaactttatattaactgaaaactaatcatttatagagatgactgagtcagtcatctacatggctcatggaaaaaatgtcacatttgtaggatttaaactaggcaagtattttcctttaaaagtatgctgtttcccctgagggatttgggaaaatccattcctttttattgctagcttataggtttgacaagtactttaattactctttgcatcgtcaatttacctggaaaacggagatagtgatgtataaaggttatacctttttttactagagacaatctgtggaaaccattttttgttttggtttgttttggtttttttttgagacagagttttgctcttgttgcccaggctggagtgcaatggcatgatctcggctcactgcaacctccacctcccaggttcaagcgattcttctgcctcagcctccagagtaactgggattacaggcatgagacaccatgcctggctaatttttgtatttttagtagagatggggtttcaccgtgttggtcaggctggtcttgaacccttgacctcagatgatccacccacctcagcctcccaaagcgctgggattacaggcgtgagccaccatgcccggctggaaactgttttaagaatacagagtttatgcaatatttcagtgaatatttttagttttagtgatctgttcataaatgtcatatctaaataaagatctaaaaatatcccaaagtttttagaatcaaagaatctttaaatgtaaagatgtcttagaatgaatctgataactgacaagcctgaactgagaccagctcctgagtcttggatctctttatctagtgttctttaccatatgtagcactttgtacatattctaaacaatattaatcaactgttagtgctcagcctggccttttcttaactatcagaccagaccaaaaagtcagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtttaaaaaaagagttttcttaatttgatatcaaaaacatttggaatttcaagatcttaatttgtttcaaatttatcttctcatccaagtgttaatttaattttctctgtgttttctttgtttttaacagatagcagaatcctatttccaggaggaggactgtatccttttcttaattacaggaagaaatttttagaactcttacagaaccattcattttttttaattgaagtatattttacatgtaatagaatgtacagatcatatggtttcagtggttttgacagttgtatgtacccgtgtaaccacctcagaaagcaaaatgtaggaaatttctgtctcttcacaaaatttcctagaaccatccaaagtttaccttcataaataggccttaattttactaaaataagtatttgtatttattttttgaaggaaaatttgtattattttaattatttttatgtacagaacactcaacagtgtacatttaacccagtttagcggcatgttctttagcctttgcctttttgagcttggcaacgtgcgccacagacttgggacccgggacattgccgcccccgtgatggtgaatctcgtcgtatctgtcgttgtaattggtcctggactagacagcccagtcttgccttccccttggataatgcagtaagggacccccattttacgacatagggcaggcaagaagacagccagctggaagaaggcattagtggaagagtgtattttgaccaaaagcagtaaatctcaaagctagcttggtagcaagcgagagagagagaacttctgagtgatcatgaagacaaaaagctgaacagtgagtttttctcttccttttttctgggtcagcatttagagcattgcccagaggaaggtaggcagttggacagtgtatcctgacctcacaagatgcagatctgtgtgatacaaatgagaaggctaaagctcacaggatcatttacaaagaagtagaatcacgtgataataatggaaatcactgtggcaagttaattgagtgtttacaaaagacccatataagtttttgccctgtcattgtttaggcatgtgatcctttggtcttgtgggagaaaagcattcagtgggaaataataaggatcaaggtgacttgaaacagaaacacttgaccagagagtcacatagttctttgacagaaagtaaggagagaaataaaaaagggaaacatgtagattccaggattccatgtggtcctgtttccttaaattacttttagttgactccgcagcagacattccttgagcattaaaaccttcttttagtttctgtttgccgatagtgtggaatccaagtagctattgcataatatgccacattaaaatttacctacttcaaaaccaagaaacattactaggctgggcgcagtggctcacacctgtaatcccagcaatttgggaggctgaggcaggcagatcgcttgaggtcaggagttcaaaaccagcctggccaacgtggtgaaaccccatcttgacaaaaatacaaaaaggagccgggcatgatggtgcatgcctgtaatcccagctactctggaggctgaggcaggagaatcacttgaatccaggagggggaggttgcaataagccaaggtggcaccactgcactccagcctcggtgacagagggagactgtgtctcaaaaaaaaaaaaagctggacgcagtgattcatgcctgtaatcccagcactttgggaggccgaggcaggcagatcacgaggtgaggagttcgagacgagcctggctcacatggtgaaaccccgtctctactaaaaatacaaaaaaatcagccaggcgcagtggtaggcgcctgtagtctcagctacctgggaggctgaggcaggagaatcgcttgaacccgggaggtggaggttgtagtgagctgagattgccccactgcactccagcctggactacagagcaagattccatctcaaggaaaaaaaaaaaaaaagagagaaacattactttagatatgtttaaatttaaaaatatttagagtcctctcatgttttagtaagctgcaaatttctcaacatctataggacattgttcttcaaatatgggaataatgtaaatagtgtggatttctattttccttaaatgttctattcagatgagaaagcaatgaaattcattcagctagaacgattgtatcatgagcaattgctcgcaaatctttctgccattcaagaacagtggggtaagtacagaccaacatggaatgtggaattagcagtaatccaacaagtcactatctacaaaattaacatatttgacctggttttataaatcagaaaatagatgtttccataaacaagttaatgttgcaaagaaagtagcatttttaccacaagtctattatattgtgagaagacttttttctttgtattttgctcttcatatcaatgccaagaaaagaatacttgcaactatttgcatttttcctaatcacatttcatgccctactggctaatttagtctctaggatgatatttacttatattgaaaagtaataagttagttatttctaactgttgggttgtttgaaaagataattttgcatgcaaatctttatgagtggtgctagttaactgtttgtttgtttttttgctcctaaatatgttttataagagccagtgactaacaaatactttaaatttagaaacaaaatggaaaactgtgcaaccacatacagttacggctctaaggaattcagaaaagggatttaatggtgaagattttgaacggcttacgaaaatttgtgcaacacatcaagagtaagtatatcagaatttcgttagaatgagttggagtagaatattgaagaagcattatagcattgagtatccatttctttgttttatgttttcaactggagaaattaagatggatataatataattattgcaaggctctagtattggttcgaaccccgggagcgcgccaacagacagcacaaggcggtgtggagcatcacgctgttttaatgagcacctgggtgcagacgggctgaggcctaaaatggcgtcagcgccacgtgaggacggggcaggggttttacagtctcctgtaaacaggaagtgtccctgtctgatgtaacggctacgtggtacctggatggcctctctgtctatcctcggtggtgcgtgtcttccggccggggtgcgtgtcttccggccggccctcttcctgcttctgcttctcgctgacgcgcgctgctggtgcaagtggcctcgcgccttgggactgggtctgaggagggaggagttattcatccccccaagctttcggccctggggagaatctttcattcctatttggttatagaaaaagggaaaaggggcaactttctccataactacttcaggtgtgacatagagggtggcgtgggcacctcggaaaaaaagaaaaaattttggcgtattcttgagagtcgggttggtatccatcgtgtcgttgtagcaggagcatcgtctggattgtctggcgattaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcgtctatgttaagacagcaattggagatgttaaacttaccacagaccgcaccctcttctgctaataagtagtctagagccagcctgttttgataaattgctgggtgcatttggttttgttgtcacgcgagcatttccagcgctggggcggtttggttagtgattatctctagagcagcctttagtctaattattctatttagcatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaaaacgaatccaggttgaattgtgcataggaagctagtgctaaggtagccgtgagtaagcctgggttccccatatccaaaggaatccatcggggcagtccatcgtcagctggtgttcctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttgactgttagggtttggtgacaggggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtgtaaagggatggaaataccacgggtgattttcaggggtagttgttggttttgagacttttgctttggctataatccattctctctttctgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaattttttggttaatttcagcttggtagaagaaactggcctggacaaccacttatctgttaatgttttggaggaagaagtagcctttggggtgagcttgaccctggtacgatggacccagttggggagtccttggactctcatgctgttagtgtgcatgctgagtatcacagcgtaggggcctgtccactttggttgtagctttttgtgaggatcaggttggccaataaacacgtctgtgcctgcaagacagttatgttgagaggacaaggaggtgtcggcagggagaggcatggcctcattcgctgcttcacaaatgaaagaccatgtctggattaaggagggtaagtaattcccgagtggctcagagtctggtgatggcggaggccctaagacaaaagttcgtccatacatgattccaaagggactataaaaagagggtgcttttggtgttgcacggagtctcatgagggtgtaagggagatttctcatccacgactggtgggtttctagagccagcttggtgagttgagctttaaggacagagttgatgttttcaagtttgcctgaagattgaggcctgtaaggtgcatggagaacccatttcattcctaaggacgtggagacaacttgggtgatttggctggtgaaggtgggcctgttattggattgcatggatgtcccaatggagtgtgaaacggggaattgtatacatgatgagagtttgtatgacaacatttgcaccttctgaagttgttgggaacgcttctacccacccagagaaagtacagacaaagactagaaggtaatggagccatttatcaggtgagtgaagtctacctgccaatcttgcccaggtacctggccctgggcttggtggttagaaaaaggcggtggccagagggagccctggggtgacactgagtggcagatacagcaggactggatgatctctggaacgcggctggaaaggtgaggacaagtgagaatagggtggagaagttgcaagagaggtttgtagccgacatggaaagagttgtggaggctttggaggataggcattgtttgagcatgaggaagaatgagaagcgcccttccttgatgtaccatggtccttgcttttggaggttctggacctggaagtcctccttttcttctgaggagtaaagaggaaagaataaggacagggacagaaactggccttgcacggttgtagggctacttgtttggccgcctgatctgctagtgcgtttccagcccgtataggattgtctggggtttggtggcccctgcaatgaatgacggcagctttctgcaggagctgggcagcctgaaggagcttgctgatgagagagccgtttatgacaggagtgttgtttgcaattaggaaaccccgttctttccagatggacaagtgtgagtgcactatgtggaacacataacgagaatctgaatatatgttcatttgttgtccagctgctagagtgagagctcgagtgagggtgatgagttcagccttttgggaggtggttcctagggggagcagattggcttcaatagtgtgggcgggtgacactatagcatagccagcatgtcggcatccttgatgtaggaaggaactgccatctacaaaccaagtaaatgaggcatctggaaggggttgatctgttaggtttggaaaaagtataagaaaggtttgaatggtgtccacacagaagtgtgcagggtcttgggaggtagtggcttcaggtaagagcatggccaggtttaaatgggagctggttagcacggtgatttggggagtttctatgaatagagcatacagttgaaggagccgtggggcagacatgagacttagtacactgcagtgagctagcatgtctttgatgttatgggttgaataaactgttaggttggcacgaagggatagttttaggcttccaagggtgaggacagcagctgccaccagtgcttggagacaggcaagccatccgagaactgtggttgtgagctgtttagagaggtaggcaacaatctggagggcgggtcccttagactggttagaacatgtagtgcaactccacgccgttcgtcgggatagagagaaaggtttggtgaggtctgggagagtgagaacgggggctgagatgagagccttctggaccagacggaaagggtgggtaatcggctgtgcagggtttaaaggcttatggagagggcctttagtagcttagtataacggtttggcaagtagagcaaaggaaggaacccagagcctaaaatatcccactagtcctagaaaagagagaatttcttgcttagtttgcggaggtgggaggaactggaggagcagtgtgcggtcggttgtgagccctcgggtttgcagggtaagagctaggcctaggtaggtgactgagggggtgcttacttgtgctttcttaggggagacccgatacccccactctgccaagaaatttaaaagacagatagcatgggcatggcagtctttttgagaggggctacacaggagcagatcatcaacatattgaaggaggtggacagttttaggaataaggtacagaggttgtgagcaagggcccgggtttcggcaccaggtgcaaggcactagtatttgttcaaatcccaagagtgcaccaaccaacagcacaaagcggtgtggagcaacacactgttttaatgagcacctgggtatagacgggctgaggcctaaaatggcgtcagccccacatgaggatggggccgaggttttatggtctcctgtaaacaggaagtgtccctgtctgatgtaactgctatgtggtacccggatggccaatctctccatcctcagggatacgtgtcttccggccagccctcttcctgcttctgctatcttgctgatgtgcacttgtcgcacaagtggccttgcgccttgggactgggcctgaggagggaggagttattcatccccccaagctttcaggccccagggagaatctttcatttattacattcctttctcagtttttattgagtttctcacactgaactcagtaaaaggtcaactttgtgtaggttcaaaagattcttctgattagatatttaaaaatataacttctgattttgatctctttttggttaggagatgagcagttcagatggacagaattgtgtattagggctttcgattcaacttgctaatgtttatgtgttgtagtaaaaacataacatttttaggagtagtctgatgctagaaagcaaatagaatacagtatctaaccaaaatcttgcagaagaaaagctgcatttaccaggtaattttcagttgcttgaattgtatcaaggagttgtattttttaaactaataataataataaggcacttacttttttaaaaaaaattccttattcagagatccagatttctgaagacaaagggagacaatagtgtttaaactagtgcaaatttctggaatttagaacatgaattctcaatacaaaggctaaaagactttccattttatggataactttttctccttttctctcagaatcatggagagtaaactaaagctctgtttgttaatagtgagacagtgccaggtaattgttgtgtagctcatacagcagataaagaactcactaacaaatatttattgaacatgacatgagcatggtgtctttatgcttcaaaatttggataactccccccatatcatttttaaattttttaatatttaaaaatattttcaagttacacataaagtgtacaagcttgatgaatttttgcatagacgtatatgtctatgtcactaccactctgagcaaggtacaagatatggaacattccagccctgcagaaggctccctcatgcacctgccaacttcgtacccacccacaatagtaaccactatctggactctataacaatatatttgcctgtcctgtaattttatataaatgggatcatgcagaatatagatttttatgtctagattcttgcacccatcagtatgtcttgttccatgttgttgcatgtaacagtggtttgctctgttttattgcagtacagatttcttggatgactatgcagcaatttattcattctattattagtagacttttaggatgtttcttgttttgtgaatattatgaataaagtggcgatgagcatttttgtgtgtgcctttaatggatatgtacattctgttatcttgggtattccctaacatttaatatttatactttttgttatctgtttccatggagaattccaacaaaattatcttcaaccataatctattttagactaaaatgacataaactgaaatttttaaaatatgtgtgtgtgaaatcgtctttattagcaaaaggttgtcattcttctttttttcttcttctggaatatagcatttgttgcttctttgggggtttccaatagcagttggccatctaaggagataaacacatgatatagctgcactttgaactatgtgagccagtggtaatgtttcagccgtggaaatgttctgtgctaatattagaatccagagaagctgtatttttttatagccatttcagtgacatttgtttggaagcatattgctgctgtaatttttttaaaattcttttttctttcttttttcctacagtcctcttttatccaaacataaggtaagagattgtttcttttgaatatatttctaggaaaaatgtttgtgtcatatgtctgttgtatggactattttggaaaatgaggaaacctttcccaagttattttcagcttcctagtttaatacaacagtttccccaaaagttgggttttcttgttttaaactttttagatagcagctgtggagaagtcccaggaaaggaaatgctccacgcagttactagtgtctgaagatccaaaggaaggaggagctaccaccaaagagtcaggtatgtttttaacttaagctatggagcaacgtaaaagatacctgcctcttctgatcttttacaagtgatacatctgaattgctgcaaaggatctggtttttttttttttttttttttgcacttacatttttgtacatatacctctcctagaaaaagagcaaaatgagactttttatattgggtagctccacattttagacatctattagtagataccataaaatctaagttcttataaaaacataaaattcttatgttttcagtaggtggttatatatatctaacagaataagaaaaggttgtacaaaatgctctgaaatagaattggtgttggtacattcatacattgttttctgtttaaaaaccaacagttattgtatacactttaccagaaatttgttctgtaaatttagatattttaaactctatatcttgataatttatagcaatttaatttctccccttttctgtttactaacatatgatatactttagtttgtatgtatacatttctaaagcatttatgatgtatttcataccaccttgtgccttacgtcaaaagattttaagaggctttcttctaaatgtttggcatgttgctcattataaaagctttagaaaataaaaataaataaatatgttttagggtttttttcccttgatacctaattttactattaatatatatttctaggctttatgttcctgggcctgagagccctaatattgaagaggaagtatcaggtgttttggatgagttgccctgaagtgatatgatgatggtgatgatggtggtgatggatggtgatgatgatgatggtgttgatgatgtcataattagccttttgccttttttccccccttttttgtttgagacagggtctcacgctgttgcccaggctggagtgcagtggcaccatcacggctcattgcagcgatctcctgggctcaagtaatcctcccgcctcagtctctccagtagctgagattataggcacacaccacggcgccccagttaatttttaaaaatttttgtgggtatggaggtctcactatgttgctcaggctggtctggaagtcctgagctcaagcgatcctctcacctcagccccacaaagtcctggaattacaggcatgagccaccatgcccggccagccttttactctttacaaagtatatttttattctttcaaatcttactttatctccttttcacttctgaaacaagctagggatattgcctggggtcagtcctactagactctgttcttccgtcttttccagtcatttttatattagaaatcacagtaaaatgagcttcataacaatcttaaaggaggaaaaatatcacaaagctgcccagtttgggtgtgaacgtgtctctgtgttgagcaccttgggaaaagtgctattacaggctgtgcatttgagtttgagacttacttagcatggttgctgcgcagcacctcctcctgcttggcctctgctttgagtcatgtggtacagatggggaaactgaggtaccaagtttcagtcacttgcttggtgctttgattcgcagctagaacctgggtcttcccatttctaattgaacgcagcctgcttctgctaagtacattgtatggattatcaaaggcttcaacaatccagatgtcccaggaataaccctatgagggagtatggactaaattctggggaaagaaatgttgctccagtttcaccaaacagtgttttaaagagaaatgtcaataatgtgggtgactctccgaatgtagtttggaactcttgccttttccaaaattatggtggagtttttttccccattattttctgtagtatttctaaataatgggatgaagcaaccattttcaggctattttgtaaataatacattgtacccacagatagtctttattacttatcacttaagtggtatctcagttcattagataccatactgtaagtggttgtatttcgtggcatagctgctgtccatcaccccatctcctactcatagaatggcacctcagactgttctgtaccttttcagtcacttataagctattaaatagtctcattttgccgggcgcgatggctcatgcctgtaatcccagcactttgggaggccgaggcgggcggttcacgaggtcaggagatcgagaccacagtgaaaccccgtctctactaaaaatacaaaaaaattagccgggcgtggtggcgggcgcctgtagtcccagctgctggagaggctgaggcaggagaatggcgtgaacccgggaggcggagcttgcagtgagctgagatggcgccactgcgctccgcctgggcgacagagcgagactctgtctccaaaaaaaaaaaaaaaaaaaaaaattgtctcattttgattatttagagcttagccctattcaatcctgaacttgattttcacatttaaatctcactgtactcaaagctcttctccgccctccagttgccagggctgggaacactgtctgctcctggttggagttagctggactggtgattatgactgaacccaggttgtgcggtggctccagcaggagcagctacggaggaggttactcccaagctgctcccctagataactgcagcctttaggtaactgaccctcaggtggaagcaacacaccccagtcctctgatgtgggggttctctctgccctgtgctttcacagtgcctgtgggactgtggtccccaatcttatttagtctctgagtcctgtggacatgttttgagggacatcttctgaacctttgggtacctggaattcatggaggagtggcttggccccctttcctttggatgtggccctcattgctctaaccttgccccattttaacagagggaggggcagacagcaagcccagtgtcaaagcaggcaaccaaagggaagtgaaaggtgcctttgttttcttgcagccttacaaactttgagtgattctttggggtggggagagagaaggaaggctgtattctcccaaaggtgaccccttcttccttctcctgatctgcatctgatatttgagtcagggtgtcaggggaggtgctatgaactctactgaatagctacctctcagcagcccgaagttgagtggcagcctcagcaccagatgctctgaaatctgcaggcaatgtttcaggaatgccttttgcttgatatggtatgggcctcaattgtcagttggtgattagtattaaagtatcaatatgtttttggagtccagggtgaaaaagaaagaaaaaaaaagtatcagtaaataaacaaatggaataaaattatcatcatattttctcttttattttcacctttggctcattatttatttaagttaaacaacatattagtataaaaaggttaaaactttttttttttttttttttttgagatggagtctcgctctgtcgcccaggctggagtgcagtggcgcaatctcggctcacagcaagctccgcctcccgggttcacgccattctcctgcctcagcctcccgagtagctgggactacaggcgcccgccaccgcgcccggctaattttttgtgtttttagtagagacggggtttcaccgtgttagacaggatggtctcgatctcctgacctcgtgatccatccgcctcggcctcccaaagtgctgggatgacaggcttgagccaccgcgcccggccaaaaaggttaaagcttctaaaatagttatgaatgctaagtgtaccaataaagcgaggataagcaagcttctctgttacctacccatccatgcacttctcattcattattcacacggaggtttttaactgtttcattttaaagtgaaggaaaaataagttggttttactcaaagtagaaattgaaagagatgtcagaattcaaacccatttctacttgttgcaaaaacttatcctttttattgctaccctttgctacctccctttaagaagttgctcggcgtggtggctcacgcctgtaatcccagcactttgggaggccgaggcgggcagatcacgaggtcaggagatctaaaccatcctggctaacacggtgaaaccccatctctactaaaaaataccaaaaattagctgggcaaggtggcgggcgcctgtagtcccagctactcgggaggctgaggcaggagaatggtgtgaacccgggaggcggagcttgcagtgagccgagatcgcgccactgtgctccagcctgggtgacagagcgaaactccgtctcaaaaaaaaaaaaaaagttgcaagtaatttgcaaacacatttattagtggtattatggtcaaattataaatttgaagagaaccgagtttgttcctttaatcttagtaaaccagaccagtactacttttcttacatttaaaatgatgaatgtgttactgaggttcatcatgtaaaaatatttacttaatacaccatgtctttttttgtttgtttgtttttgagatggagttttgctcttgttgcccaggctggagtgcaatggcgtgatctcaggtaaccgcagcctccgcctcccgggttcaagcaattctcttgcctcagcctcccgagtagctgggattacaggcatgtgccaccacgcccagctaattttgtgtttttaatagagacggggtttctccatgttggtcaggctggtttcgaattcccgacctcaggtgatccgcccacctcggcctcccaaagtgctgggactacaggcgtgagccactgtgcctggccccatacaccatgccttaaatgtgctgaaaataatttttgtaacttcattttaatgtaaaagtttaataaagttcagaatatcttttaaacctttgaaaatgactttgttgattttaatgaggactaagtgatttattcatattcacatgcttttgaataatccctgttatgtataaggattctttactaaatattttgggtatttcctctacctaaagacactattatgcaacagacagaatttccatttgaaagggttagaatattgctgtattacacatattcatatgtcccttcttttccttcctatacaaagtgttgttttgaatttttaacaatttatttttcttcatctttagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatactacaagatgttctattgcatgcctccagctagagtgagcgttattgtatatatccattttttatagtcctgactgttatgtggcagttccagatattggaatcaaaaccagaatagtcacattctaataaggaagtctcatttttcttctcatacatctagcagataaaatatgatatgtacttactgtttcttcctcttgttaatatattttttaagtcttttaaaatagtctaaagaatagagggaacattttaaaatataagaggtactagattaatttttaaccttatattaagttgaaaaaagagattaaggaaaaattaccatttttcattgtttgataatacaaaaaaaaagtttggaaaaagaaaagataaaagccatatccaaactacagcacactcacgaaggcggcctggtgtggtagagcagaattcgattgccttagttccagtacaatcccaccaggtagttaacagcttcttggagttaccttttacctctgtaagcctgttttcttctctgaaaattaggatactagctgcctttccttttcttcaccatttttccccccaagttcacttttaagtcccatttgtactcattgtgttctaaatcagcattatcattgaaaaaataagggggaaaatgaaaaagtaacaaagccaaagtagacagtaaaatatatgtgaaaacagaagactgaaaagctgtctaaggtaattatagctgctatattactagctccctttattgccatttatagtcaattctctataaacaatgacttttctttttaatttttttcttgccaaaattagatagaatagtaaagcacttggcttactattcattctcttattttaaccagacagcttggttgccatttgcagttaattctctacagactgttgttttgtttttttttttttttcgtagtttttgcttaacaaaattatttaatattgcttaatgggcacagaatttccatttggggcaatgaaaaatgttggaaatagatggtggtgatggtacacgttttgattgcaatgaatgccactgaattgtatacttacaaagagttaaaatggcagtttcatgtgatatatatttttccacaatgttaaaaatagttttttaaaaaattagagctaatggtatagcacttaatccggtattcattctcttgtacattttaactaaatctctggtacaggaagttaacaacacaaagcttatacccatattcaaatcttagctgtaataccaaaaagttaccattgtctgactgtcctttctcatgccaacaatcaagttgaccataaagggagaacccatgtggtctaattttacctttttaggtataaactgtgaagaagaagcagagagctcctgttgtcttgcccaccttataaaacgttttcctctatttcaacatttgactagttacacactgataatcatatggtgtgcctttttagaactatctttccccagtaactcatatttgggaggataataggaacttttggaatttcaatttttgcttctgcctgaaagctgttcggctggataaatttctatcatctagtttgccagatgtcccctccagagcaattctttgagttttggtaacctttatcttcaacctcctccctactcagctgtgttgaagatgcacaagggtcttgtcgtggatgtatcaaaggtctgtagcatttctcctgtatatttcagtcatctattgacatgtatttccaaagcctacaattgatcaacatccctttcccaaattatttttccccacatcactaaatttaaaattgttctcaactgagtcatcctatttctaagaaattaaagagttgtttatattggggaaaaaatattttaaggtggcagattgttaaattaatgttgcgtattacaattaaatggaatattccctcctcagactcaaaacacaatgtcacttctgctgggtaacagctaacagtggaaattacatgtgtttaaagttgtcttttctattaagttaatacataatggtctcctttcctaagattatattgatctattaagttaagctattttaagaaccccaaaagctacatatacatgacttacaaaactaatttactttcctatgacaatgccaagcagattgttaaacatttgctttctgaatacttactaccctcgctattctgaaaagcatggtttaacaaagtctgcctaactctgtcaggaaaggagtttttaaagtttcaatgctaaaaatcactaatacttaatattttctaataccttaacaatgaggttttggaccaagtaaaatatccaggcaattgtgggtttgcttataagtgcaaacttaggatttttattttaaaaatttcttttagatttgaacatataaaattttaattcaaactttttttttttttttttttgatacagagtctcactctgtcgcccaggctggagtgcagcggcacgatctcagctcactgcaacctccatctcctgggttcaagcaatactcgtgcctcagtctgtcgagtagctgggactacaggcatgcaccaccatgccctgctactttttatatttttagtagagatggggtttcaccatgttggccaggctggtcttcaactcctggcctcaagtaatccacctacctcggcctaccaaagtgctgggattacaggcttgagctaccatgcttggccttcaaacactttttctgtttgtgctttcagtaaaattttattaagagtcttccctgtgtttggtgctgaggatacaatgagaaatcagatgatgttgttggccttttgggggatctctgctgtcacacttggctgattttactggaattgtttttgaaatttttttttatgcttccttccgtttgtgattagaggatatagaacatgatctcttaataaccaagtaattatgaacaacatttttcttgcacttaggaaccccgaggcaatgagtctgccccctccacccctccacgctgctgtgctatcgcaggtggtccttctctgttcgctttcccagatctccctatcatttctccccgcccaggttctcttacttccctctttctaccattgtgtttgtggtagagcatgctggtttgttctttctttgccagctttcccctttcctcttgtctgtctgctttcattttcttgccacttttgcattgcccagccttggctccagtggaatttggttttgatcatcattgccagcccagtgcaagcacttgttttgttgtgttgctttgaacagttggattcatcagatcaaatgaaataatttacataaaatgtcacagagaactaaaaatgtctatactatttatatagtgacatgtataaagggaacttgtctaggtttggaaagctttttcaaacccagtaatttgctatgtaaagtgatagcttaatatctgaagtattgctattctttcttacataaaaaatagcatgacacgttatcatcaaaagtatagtttatactgtatactgtttttaaaaagcatcaaaaattttatcctcctttcatagatttttaagaaaaaaaatgatcacatgtgcattgtcagacaacacattggaaagatttactcgtttattctctcattctgtaatttttattgagtgacttctctgtgagggccgcattacagatgcagtgactgaaaatacacgtaaggatttttatgcagatgaagcctgcaatctaacagtcgtctggcaccaagtgtgttgtctttttgctgaatttgaacatcccatagtttttggcaaaggatgaaattgtattataatacctataatacactgacgtgatgattttagtgtcagaacccaaaccccctttactcaggaacctgatcatgcaaataaatcatgtgtttgtttggttctggaacctggaagagttgcattatcttctctttaaactcttcagctgttcctcctgtagcctgagactcagagggagctcctagcatccaaacttgaacgaaatgtgccatgtaaactcagagtgccaggatgacccacgggggtgcgcactcagcttgtacagactcttacacacatagagatgaggtagctgttttctgaacaagtgaggttgaaattgaatgttggatacattttacgaaagttaatctatttttgaacattgaaaataatcatagtatgtaattcagaggtccccttgtgagcagattttagcaacatgatatgctgtgtggagataaaccattcatttttcttcattaacatctacatttataatctgcttgcagaaatgtcatatgttcagaaaaatatattaagtgtttcagattgaagtgatttttgtttttagaaataatttcattatttctaaaatctgaggaagaagccctgtgttactgcttgggtctttagaaagcttttaatctggccgggcacagtggctcacgcctgtaatcccagcactttgggaggccaaggcgggcggatcacgaggtcaggagatcgagaccatcctggctaacacggtgaaaccccgtctctactaaaaatacaaaaaactagccgggcgtggtggcgggcgcctgtagtcccagctactcgggaggctgaggcaggagaatggcgtgaacctgggaggcggagcttgcagtgagccgagattgcaccactgcactccagcctgggctacagagtgagactctgtctcaaaaaaaaaaaaaaagaaagcttttaatctaggagagagcaactcatgttccttgccctctgtctagattagcaacatttacttaaatgttttcagaactgcttgtatcacatgaagcaaaatacaggggaggacataagttcacagtgtctagtggggagaaaaatgacaacccagattgctcctggatttgcctttagagaagctatctaatcgaagctgtgagttttcttccctgttgcctattaagtgaggtagttatttcttgactagatagatcactgggatcagggaagttactttacgactagctgctgtgggattctcttgccaagtgaagatgggaggctagcactaagcagtagtcgcttatgaaatcacattggtagctgctctatggatccggaacaaaagagggtcttagaaacagcaatcatggttgttctgcccagaatggctcttttgagaggagcaggggaagtccagcctcctcacaatagaagaaatgcagtcttccaataatgtaagaggttttagaaacaatggttggcccagaatttatgtagatatctaaagagcgcccaaaggaaaacccaggaattacctgttttccaaatggcctcgtccttgccttttgtttttatcatgacctctacattttctaattaattaatgcttctcttgatagccatgtctcttgcgcaaagctctttttcttttcctttttaatcactcttttaatttatatttgtactgctcttcctggacttttgcagtagttacttaataagtttccctgtcccttgtttcatcttctcccctccaaattggtcttacgttagcactctataaacttggggtctcaaactggtacccaaggagccagtcaggtattagaagtcaatgaaatgagttaggtgtagagtgataggaagaaggtttccacgccttgtctggaagtatacagcttttttaaactccacagattaaaccaaccacagctgagggttcttgatcgaacacacggactgtgagtttaaactcctgctatgaaacacttttaaactatcattcctttcccacggctctctttacctgcaggataaaggctgtactactcgacattcaggactcctgtcatctggcccactctgtctccccaacgtcatcttctgtcctggggtctcagactataccgtagtcagactggccccctcgccacctcccagatacaccttgcatgtcgtcacgtttgctcttttccctctgtgtatgtcagctccaccctgaggtgagcaaccttctttccacatacctatctcttcccagccctccacatctaggtcatggctttttagcatggagagtaccaaacagtgcctagctcatggccagtactcagtaagtgctagctgatgctatgattccctgatcactggagtccagaagtttgtttctttcaaacaattcctcggaacttcaaatgaggttgaggctggaacatcactcttcccaaagtcctgtctagctgtaatctctctctgttatcgtaagacgcacacatactgtcttctacatcaaactgcaaactccttaaagatacggattctgttaaatacatctttatattctctgcaaagctaatacaggctgttgtaaataacagccactatacacagtaaggctttttttcttagttcacttataaaaataaatatcctttaatgatagatttggttttgattattttcagtgaaaaagctacattactcaaacaagtatttgctaggtgctatctatatgtaaattgcttatctgtgtttttttttttattctttggcatatttagtgagcacctactatattatagaaactaggaagacagcgctgaacacagatcaagtccctgctctcataaagcttactttctagagggagagacacgtaataagttaacataaaaacaaaaatatagttttggatactggaagaactattaaagaatttcagcaaggtcaggggatttaaagtaactgaactggcagctatttaaacaattttctgggccttaaaaatgggatcatatcttgacattctcatttctttttctattttgtacttactaaattgcccccttaagcaagcaaaacaaattgcaaaaacatgaggtaatgcctcacctagaaacttagacacattgtaaaactcctgtgatttttttaaaggctttttcctttttaagtgaatcttttaaagattcgacattgatgtacttcatcatcatgcgtttttccccttgtttgccttctccctgtattgcagtgttctaagatgcagtgctgtgggtctgaggtgaccgccgtgttctttctggaaaatggctgctgcttacagctggtactccctggcccagcggtgacatgtttttatcaatctgccatagaaggagccatgacattagtctacttccagattaatcaaatgacacaaagatctttcatctaatctcctcttcccctgtgtctctagatgggcaaatttggccattagtttaagtatctcataaatgaggtgatgtgtaagataagaatttttgctagagtcttatttgaaagttctattaatcttgttttaattgtaatatatattatagcatatggcataaagcaacattttaatagtcatagaaaataagatattttcacattaaggaactggcaagaggtttgatactgaatttgttttcaaactctaccagctactggcactgcaagcttaagcaagttactcaagcccttgaagcttggcctcttcgtctgcaaaatggggctgataaggcttctaaaagagagttgtgaaaattaaatatgatatagtatgtaaatatcgttacataaaatgtacacatttactaaattatagttgttattatggaacccaacactaaagaagcgggcagagaatatcacttgtttctgtagttaggaatagtagcagtaaatttgacatgtgccactatagtgaaattgctggcacttaagttatttgtcatatactataataatatgatttatgaatgttaattctcaaatcagttggaagccaactgtgtgttcttgttcagaattgaccaacctagaggttctgaattgagtgaaacctatatcattaaaagaatgtgacttggtatctgttttcttctttaattttgtgaggaggcacttccaacagcagtgtgtctctgaatatttttcttgtcacattaggattcactattccagaagagttgcgaataattttgttttcacaactagttcattctgaaaatgctatttaaggtggtcactgatatttgaggggaagtgtgggaagaactatttatttgcaaatacagaagactgggccagatggaattttttttaattctgcatttattcatagagcaccacccgtaacaattacattaattatagctcagacattctttttggtctcaatagaagggcttggtatatttgtttgggtaagaatttggcaattgaagtgggaaactaaatttagttttaaggctttattttttgagatttaaaaattcttcaccttttaatactgacactatagttttaaaaacaatggaaatatttttaagaatagtctggggccgggcacagtggcgcaaatctgtaatcctggtgctttgggttgcttgagcccaggagttcgagaccagcctgggcaacacagcaaaaccctgtctccacaaaagaatgccaaaaacattagccaggcatggtggcgtgtgcctgtagtcccagctacaggaggctaaggtgggaggattgcttgagcctaggaggttgaggctgcagcgagctgtcagcatgccactgcactccagcctgggcaacagagtgcgaccctctctcaaaaaaaacagacaaaaacaaaacaaaataatagtttggagggaacacattgctctatgccctaaatcagcagcccagtgtattttagaaacacttgtcagtcttttgagtgagaccccaaaccgagaccatgactttgttttgtcttacttgcccttcaagtatgaaattgaggcaaaccccaccaaacttgtttcttaagatctttatgttggactgccctgaagtggtaagaaaaaattctgttacaggtagatctgaactgcgcccaaaactctcgcaaaaatagaaaggctcgatgctgtccgccactcccacctgagagtgcctccttggcctgcatctcttatgcataagcttggcccaccgtcccttgttctccatctgtaggctgtagaatcagaagacagttacaacagaaagacctagagaagatcactgagcaagaactgaaaggaaatgatggaaaagagcagactccttcacttcagacactggggcaggccctgctgaaacaaaagggttttggtggcagaaaaaaaaggcgtggttcgatttttagcaagaattaaggtattgtgacggagggggtgtcaaaaatgttagcccatcccacacaattgtaatttctcatactctgcttctcccatctttaaaaagaattcagaaaaagttgccagagttcattgccacccatagtaaataaggtgggaccacctgacaaggcttgtatcccttagtgttgacttccacagccaaacaccaccctccctggttgaggctgagcaggagctaaggcagggacctcacagccgctgcactaggaccagctctaggttcagttggctcattctgtgcctttccagatgatttcaggagcttctcttcctctgtcaacatgtttgttcctatttgcattgtcttttgatttatggcttgtatccgtttcttgaatttatagatgcagaattcatatcagaaagatcaattaagagcaacacaactctggggctcatctttaaaactattcttaatagggttgttttttctaagtagttaaaacggcaccttgaaaatccctgtggtaggtgaattcaccattggtaagtgtatgacagtattttatggagaaaatagatcgtgaaggaatcaataaacttcctccccgcttttaaaatttttggaaaaattttagaacagccagattcaagatcctctccttttttttacatgtactaaaaattaaaagaatatcaatgatacatctttagtagtaatgtattcatgaaaattaattcttgttttccatcttttgctctttacaaactggttaagactgtttccctctcagtgtcagcaaggtgcttataaaacctgttttctctgttgtgtgagggagttctttaatgacgatgttgctttcttcatatatttgtactttaccatttcaaggccactaaagtacttctgttttctcagaacaaggacttctgaaatacattatttcctataaaaagaaaagaatatattgttggcttgttgattttttttttgagataatggtttctatagacccacattcagggaagcatagtcaaagactatcttggtctatttggccctaaaagccctaagatataaaaagaactaatcgaatctgtaatatttatgcatagcgcattatcgaagatggctggctggaactgcaagtcatatttagtgttttatgctattgattagataaatgacattagaggccatcctcagcttagtcactgaggccagcaagtcactgatgccagcaagtcactggcctgatgccagcaagtcactgacatcttcggtgttaggcccacagtgcctgcctgtgtcatcacctacagcttgtagcaatcaggcaactaacaagttaacttctgtgactggccctgctgttcaggggccttcggcaaggcctcctgcttcccagcctggctctcccacctgctcctcttccttcttcctgcaccttggagtctgttagctcctaaatggcgagggtttttggttttgtttctaaataaggggtggaacataggcaggagagaggcagcccaagtgaaagagctagaaggcaacatataaaggggtggggtgggtgtctgaagagatattaggcagcagactttttctaggaaaggccaaattactaatattttaggctctatgatctcttagaaccgcacagtgccattgtagcccagaagcagctgtgcacagtgttcagatgaatcggctcagctgtgttccaattaaattatattcacaaaagtaggcagcactggcctttggcctgtgggccatagtttgccaacctctgcatactagaaagtaatatgtcccaggccgggtgcggtggctcacacctgtaatcccagcactttgggaggccaaggcgggcagatcacgaggtcaggagatcgagaccatcctggctaactcggtgaaaccccgtctctactgaaaatacaaaaaaattagccgagcatggtggcgggtgcctgtagtcccagctaccccggaggctgaggcaggagaacggcatgaacccgggaggcggagattgcagtgagccgagatcgcgccactgcactccagcctgggcgacagagcaagactctgtctcaaaaaaaaaaaaaatgtccctagtaaactggctctgagagaaattctggaagtccttaaaatattgtgagcagtagagcattatttagtaaatgcgtagtttctcagagaaactgaggacaacactttaatgttaaaagcttggtatctaaatatattttaagcttcatatgttcatttgtttaaaattgctgatgaatgaaaaaagcagtggaggattataagcatttattataaagcaaaacccagtgctaatgacgaagcaaagaggggactgtgagtgatcattttaccgataacagggaagttaagctacaaagcaaggtgttctgatttccagtcgactgaacacgtcatgctgcctgtccccggagtgagttcaggggttaaaaaaggaaaccagggttttggacttttgtgtttctcagtcatctgcagagaagtgaaagttttattctgttagattttgatgttatttttttctataggaattggatacccctgtaataaaaattcaaatatctgttgaatgagcctttttatagctacatgtagagatgtcccgccttaataaaagaattataggttcttataatttctgacaggttgttcctactgaaggattggtctccatattaaagaagaggaatgatactgtaggagatcatcctgcccaaatgcaacacaaaccatctaagcgaagagtgagattccaagaaatagacgatagcttggatcaaggtaaaccgcttggcactgtggctagcaggatagatgctcagtgtttgctgaaaggatgagtttgtgaatgatgtgacgtttactaacaggatttgtaaaagactatgtccgccaggcacggtggctcacacctgtaatcccagcactttaggaggctcaggcgggcagatcacttgaaatcaggagttcgagacaagcctgaccaacatgacaaaaccctgtgtccactaaaattagaaaaattagcgagtgtgggggtacgcgcctgtaatcccagctactcaggagactgaagcaggagaatcgcttgaacccgggagacaggttacagtgagccaagagcgtgccactgcacttcagcctaggtggcagagcgaggctccatctcaaaaaataaatataaataagtaaataaaagaatatgtcagtttagttgctttatcttctaagggagaaacatataaaatccaactatcatcttaaatcatttctaaatctttacttgcttaaataagtgagcaagctgcaaaattcaacttgtggcctccctgttccatagacagttaatgttgagagcttagttcagtttccctctttagtactttttgtgtgagtctgctatttttgtcttttgttgtttttttgttttttttttaagacggtcttgctctgtcacccaggctggattgcagtggcgcaaatcactgcaacctcaacctccacctcccaggttcaagcaattctcctgcctcagcctcctgagtagctgggcttacaggcacatgccaccacgcccggctaatttttgtatttttagtggagacggggtttcaccatgttggtcaggctggtctcaaactcctaacctcatgaggttaggatctgcctgccttggcctcccaaagtgctaggattacaggtgtgagccaccgcaccaggccctggctagttttctgtatttttagtagagatgaggttttgccatgttggccaggctagtctcgaactcctggcttcaagtgatccacccacctcggcctcccaaagtgctgggattacaggcatgagccaccatgcccggcttgtcttcttttcagtggacaattaatactcctcctttattgtggaaaatatttatgaatattctcttcagtgatttcctcttcattgatagaaaagagtgtctctcgagagcagcagttttacaccattgctgctgtttgacttcttcgtcctgggcctgtcaaacttaaggccctgacttggtctaacatgaggtggtgagttttgtagtgaacaatgctgccttttatggttgcaaatatgtttatctaaggtgtaagtaaataagagtaaatggaaaggtaacccagaacctgtcagtgggcttctcatattcataaaacaactgcattgttaaaataacagtgtaaatatttaggtatgctttctgggtgtgacataagtgataacagtagaggtttctgcatttttacaattagaaagctggttagggggccttagaaataatgtcctaacccctgattttacttctgcaccttgcttgtaactctcacagtcttctccagataaggtgctcacttctgtttgcactaatttgaccaaatcgttccttaataggaggaaccccggatttgaaactcacagtctgcatttcactttgtagccacctcatcttaaactaagtcacttacttgtaggagactgagttccatcatctttaaaataaggagaataacatctgcctctctgtccctattgaaaagcgtgtcagataatatgtataaattcattttgagaattataaaactaaatgtaaatgttgattgtgttggtttgttcctaagctctgtgacttacacggtgttttcataaacctcaccttctgccaaaatcttcctaaaagggcctgttcttccttctgtaagccaatgctatcccctggaaattaatgtgaggcacatgtatgattttcagctttgtagtagccatgttaaagtgaaaagaaacaggtgagatgaattttattttttatttgattttattttttttgagacgggatctcactctgtcgcccggctggagtgcagtggtgcgatcttggctcgctgcaacctccgcctcccgagttcaagcgattcttctgcctcagcctcccaggtagctgggattacaggcatgttccccgacgcctggctaatttttgtacttttagtagagacagggggtttcaccatgttggccaggctggtctcgaactcctgacctcaggtgatctgcctgcctcggcctcccaaagtgctgggattacaggcgtgagccaccgcacctggccagaattttaagaatgtattttatttaacccagtacataaaaattatttcaaaatgtgatctatatgaaaaaattactagtgagacattttacatcctttttttcacactaagtattcagaatctgtgttcatcgccgctcagtttggaccagctacatgtcaagtgcccaacagccacctgtggctcacatcggacagtacagctcagacaggtctaggacatataaataaaacaaacagcatagatgcttttacatatttaagctatatttaaatgtttggatttgaatatatgataatgaagaaaaatactttaggttgttaacatagatgaagtgggggtaggaatcatgttaagaaaagcacgtaaggcatggtgcagtggctcacacctgtcatcccagcacttggggaagcctcctcccaagtcttcctcctggatcactcgaggccaggagttggagaccagcctgggcaaacatggcaagaccccatctctacaaaaaatacagaaattagcagggcatggtggtgtgtgcacctttggtcccagctacttgggaggctgagatgggaggatcgcttgagcccaggaggttgaggctgcagtgagtgtggcctggtgacagagcacaaccctatgtctaaaaaaaaaaaaaaaagaaagacaagaccgaactgtccaaaaaaatacagcatgattaatatgatcctatttcttcatttatataaaagacatattttcatacataggtataaactattttagactgggcgtggtggcttatgcctgtaatcccagcactttgggaggccaaggcgggcaaatcacctgaggtcaggagtttgagaccagcctggccaatatggtgaaaccccatctctataacaatacaaaaagtagccaggcatgatggcaggtgcctgtaatctcagctacccaggaggctgaggcaggagaattgcttgaacccaggaggcagaggttgcagtgagccaagatcacaccattgcactctagcctgggcaacaagaacaagactctgtctcaaaaaaaaaaacaactattttaaaatgtaaatttcagagcaaacaattttttaatcctattttgatgtaagtcctgaaatcatacgtgtttgatctgaaatgacacacaccaaatttaacagtgtttacctctgggatgggaaggaaatatgattgggcgggagaaaaacggatagtcccttagactctaagatgcttttggggttgcgtttttacagggagaatatattcatgtattactgcacaatgttctaaataaagtctatttggtatccattaggttttgtaaaatttgtttcttgtaaaaatatatgctaattatgaaaaaaatcagtttaataaagtaaaaattaaatcatgagtcttagacatccttcaatgaaagaacatattaaatttacttcattctattaaatacttacatcatattccattatataaatgtcccataattgtttaactgttccattgtaaccagaaccactaagttattcccagccttttgttataacaaaccctgctgcagtgaacaagcttgtatatatgatatttgttgtgcagaactgtagcctaattcttaaaggtggatttgctgggatatgttgaaactatatgtcccaggtggcctgaggccgtcctggtttacacctgttgtcccggaattgcattcagttaacactgtctttttttctttttttttttttgagaaggagtctcgccctgtggcccaggctggagtgcagtggtgtgatctcagctcactgcaacctccgcctcccaggttcatgccattctcctgcctcagcctcctgagtagctgagactataggcacctgccaccacgcccagctgattttttatatttttagtagagacggggtttcaccgtgtcagccaggatggtctcgatctcctgacctcgtgatccgcccgcctcagcctcccaaagtgctgggattacaggcgtgagccaccacacccagccttaacactgtcttttactctcaaaattgtccagtctgtaggataaattaattttaaattttaatagatactgccaaattaccttccaaaaaggcattcctacactttaatcatgctgcagatcagaagactttttggtctttttgaaattaaaattttttttaaattatgaataattaagatatttttcaaccaaagaatgattgttttcttcaatatagaaagatgcaaaagagatcccacccaaaggcatttttattgtttaatattaagtcgactttgctctcaggtagtcccattatgtgaaccccaaggatcttagaacagccaggctgtactgtagactgtcaaataatgctgtcggggtgggcatgctggctcacacctgtaatcccagtactttgagaggccatgacatgaagataacttgaggccaggagttcaagaccaccctctgcagcatagtgagaccccatctctaccaaaaaataaaaaataaatagccaggcatggtggcacaggcctgtagtcctagctgctcaggaggctgaggcaggaggactacttgagcccaggtgtcagggctgcagtgagccaagattttgccactgcacttcagccagggtgacaaagtgagaccctgtctctaaaaaacaaacaaaaatgaatgaattcattaatgcgtgctatgagcacgtgagctgtttttcttcttctcatggagtgattctgtccattgtataaatgagctagttttaattttagcttgtacaagctccacaagtctgaatcttcttggtatttaataggtaggtctttgtagagtcattagcagcatgagttttctgtcaatacttcctatccgtagaggaccaacagtagaaatgtgtagttatcttaattagtgaaaagacagcagatgctaagatttccatttcggtgacaatgtaacctcactctttctcatgtttgcagatgaagttggaggtggctcctgtattttgctggtcttgctgtgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatttcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacggctcttctgctttaaaatacctcccccatctgctgacagtagctgaagattattctaaacattcattcttttagatttaaaaataaaaatcttctggagga

SEQ ID NO: 2603 - DNA, 25704 bp, Homo sapiens
cttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactag

SEQ ID NO: 2604 - DNA, 8250 bp, Homo sapiens
gttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtg

SEQ ID NO: 2605 - DNA, 54084 bp, Homo sapiens
taggctggaaagtggaggatccggtttgctctgggcgggtctggaagcagagccggcggagggagcgccggggccctgggctgcaggaggttgcggcggccgcggcagcatggtggtgccggagaaggagcaggtgagcgccggaccagggtctgcgggagcgcggagctggggacctcgcctccaggctcccagagaggagggcgctggacacccagattcctgggtcagacggaggagggggatgggagggtccaggttccagggtccagggcatgggggtcgagactcctgagtctggagcgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagagggtccgcggcccgctgaccccgcccgcggatggtcacgccccagccctgctccttccccattcctggactcggggaccttcccaagggcgttccttgccgacgctctccctctaggagcgtttgggtctgtgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgggcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagtttttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttggtcttgaactcttgatctcaggcaatgcacctgccttggctttccaaagtactgggattacaggtgtgagccaccgcgcccagccctctagttgtttttcaagacagtttttggggtgcgggaagtatccacattcctacttcagtgtgtattttgttatgactatatattagtgcagtatggcttgtaaatgatggataaataaacagatatgcgcttgttggacgtgagtgctcaaaacctttttactgataggtcagtgtggtcaagacaatttaggaaactctggtctggcctgaggaggaagaaacgcagaagataattatagtaaggcaaggggttgcagctcccaaagacgagccactgggctctgtgagagctgggaggaggtgtttgcttaagactgggaggggacacaaaatgtcactaatggtttctggagggaggaagagtggctagtgaggtgacatttgaaagtgagctggagagaggcccatggaaagcgatttggggccgggcattgtggctcacgcctgtcatcccaacaatctgggaggccgaggcgggtggatcacctaagtcaggagttcgagaccagcttggctaacatggtgcaaccctatctctactaaaaatacaaaaattaactgggcgtattggcgcatgcctgtaatcccagctactcaggaggcaggagaatcacttaaacctgggagacggaggctactatgagcagagatcacgtcactgcactccagcctgggtgacagagcaagactccatctcaaaaaaaaaaaaaaaaagaaagaaagaaagaaaaaagtgatttgaacagcatgtgcaaagtccttgctaaggaccatatggtttggcttgaatatgaatcaaagttcagggtgcagggagcactgtcatgagagaagaggctgcagaggagggcagggccagagcttgcagggtgtcagaggccaccctaaggggctgggatcttgtccttgggagctggggcatcaccgcagcagtggggttggctctgggtgtggaaaaactttctggggctgggagaggatgaacaggagctcgggaggaggctgtagagagcgtctgagcgggaggggtagtggcctgagccaggtcagggctttcgggacacagagaggagggcatggggcaaagactcagggggcaggaaggcagagcttggggcttgatgagggtgatgagggagagagggggtgccgccatcggtggatggctccgggacgtatgctctgctgactgggacacagtggggctgtccctgagatggagagctcaggagggcaagcaggtttgggaaatgtcgctgagtgcaatgtgggaatctgtgcatatgagcggcctagggggaccgaggggcatgtggggactgagattgggaaaggtctggactaatgtccagaatctgagaggtccgagttgtagctggtaattgaaactggaagtaggtaagacgtcacagggaaaacaacgtgtaaagtcaggggagttgcaaactggcaattctatagccaattgtgtgcgtgtgtttgtgtgtgtgtgtgtttagaagagcatttaaaaatatctgtcttctgtctctctctcttttttttttttttttttttttgagacagggtcttgctctgttgtccaggctggagtggcacgatcatggttcactgcagccttgacctgctgggctcaagcgatcctcccacatgagcctccggagtagctgggaccacaggcatgcaccaccatgcctggctaattttaaaattttttgtagaaaccgggtctccctttgataccagaccaggctggtatccaactcctggactcaagtgagcctcccacctcactctgcctgccaaagtgctggaattacaggcgagagccaccatacccggctacctcttttttttttttgagacggagtctcgctctatcacccaggctggagtgcagtagtgcgatctcggctcacttcaacctctgcctcctgggttcaagcgattctcctgcctcagccccccgagtagctgggattacaggcacccaccatcacgcctggctaatttttgtacttttagtagagacaaggtttcaccatgttggccaggctgatctcgaactcctgacctcaagtgatctgcccacctgggcctcccaacgtgctgggattacaggtgtgagccactgctcctggccctggctacttctttctgttgagttacttgactggcctctgcacacattgggtttgagaatcatgtagggaaggcttgcactgggaacacctacactcaagggaggtgaaaagcaagagaaagccacaaacaagtcaggcatgaagcagccggggcggggaggaaggccagaggggcaggggtatcctgccaaggagagggtttccagaatgagagcctttcagctgtagccagggccacttgtgatacagtcagatgaaacctgaataagggccgttgtatatggagccaggcaggaaattgatgatttttatcaagaacaatttcaggccaggcacagtgactcacagctgtaatcccagcagtttgagaggccgaggtgggctgatcacttgaggtcaggagtttgagaccagcctggccaatgtggtaaaaccccatctctactaaaaatacaaaaactagccaggtactgtggcacatgcctgtaatcccagctactcaggatgctgaggcacgagagtcgcttgagcccaggtggcagaggttgcagtgagctgagatcgtaccactgcattctagcctgggagacagagcgagactccatctcaaaacaaaacaaaacaaacaaacaaacaaaaaaacaatttatttcagtttctgtggctccaccgaggaaagagtgtaggaggcaagctgtgcagaaggaatggctcctagcactgaatgtcagaattttccacgattttggaaacgttctatgtctacatccaatatggcagtcctggccacagggggctactgggcacttggaatatggccattgtacctgagaaactgaatttttttttgaggtggagtctcgctctgtcgcccaggctggagtgcagtggtgcaatcttggctcactgcaacctccgcctcccgggttcatgccattctcctgcctcagcctcccgagtagctgggactacaggcacccgccaccatgccaagctgatttttgtatttttagtagaaacagggtttcaccatgttggccaggctggtctcaaagtcctgacctcaggtgatccgcccaccttggcctccctaagttctgggattacaggcatgaaccactgcacttgacctgaattttttatttgatttaattttaacttattagaacagaaagagctccatggctacaaagaacccatgcagctatcacattggacagtacaagctccagactattccgtgaagagcttttattttattattattatttttttttttttttgaggcagagtctcattctgttgcccaggctggagtgcagtggcacaatctctgctcatcacaacctccgtctcccaggttcaagtgattctcctgcctcagcctcctgagtagctgggactacaggcgcgtaccaccatgcccggctaatttttgtatttttagtagagataaggtttcactatgttggccaggctggtctcgaactcctgacctcatgatccgcccgccttggcctcccaaagtgctgggattacagtcatgagccaccatgcccggccttatttcttatttttagtgacatggtcttgctctgttgcctagcctgaactgcagtggtgtgatcatggcttattgcagccttgaactcctgagctcaagtgatcctcctgctacagcctcctgagtagctggaaccacaggcgtgcaccaccacacctggctaattaaaacaattttttttgtagggatggggtctcgctctattgcccaggctgttctcaaactcctgggctcaagcagtccttctgccttgacctcccaaagtgcttggattgtgcccagccgtccttgaagttttgctcagaagagcaaactttctgggaagtagctgcaggtgttggaagtagctgcaggggaactaggggattcaaggatggagctgaaatgggtgaacggacaaagtcggtaaactgaggcatgccagggccctggaggtagactcaggaatgaagaagacactttattgtagttctcactgtgccaggacctggcctaagtgtgtttggttcatcccatgtgtggatcagttagccgttcttttagtgtctttacggcttttgccaaatccttgtagcacctctgctatcccttctgtaaaattgctcttaaatctgctcactaggtttgtgtaaatacaggtctcccctgatatctgaactcctggaatctggaacaaagaatttagatacatttttctccttctttcttcctttctctttcttttcttttcttttctctctctctttctttctttctctctttctctttctttctctctctttccctccctccctccctcccttccttccttccttcctttccttcctccctctctgtctctctccctccctccttcctttctttccttagttttttttttttttttttttttttttttttttttgagatggagtttcgctcttgtctcccaggctggagtacaatagtgtgatggctcactgcaacttctgcctcctgggttcaaccaattctcctgcctcagccttctgagtagctgggattacaggcacccgccaccacgaccagctaatttttgtattttttttagtacagacagtgtttcaccatgttggccagtctggtctcaaactcttgacctcagatgatccacccgcctcagcctcccaaagtgctgggattacaggcatgagccactgcgcccggcctcttgcttgcttgcttgcttgcttgcttgcttgcttgcttgcttttctttccttcttttcttttttttgaacagggtctcactctgttgcccaggttggagtgcagtggcgtggtcacagctctctgcatcactgcagccttgatctcccaggctgaagtgatcctcctgcctcagcctcctaagcacatgctgccacacctggctaattttattttattttattttatttatttatttatttttagagacagggtctgactatattgcacagctggtctcgaactcctgggttcaggtgatcctctggccccagcctcccaaagtgctaggattacaggcatgagccatcatacccgaccctacattttcaaatgaatttctcattctccaaacccctgttacttactcaggtgccaatcacctttagaaagcaagagagacttgtgcatttctttaggtgggggaaagttttatatgtggaaactttccaaatggaaacctgttccatttggcacagagaggaagaaacaagccacacagaagccaaagacaatgaaaagcaaacaaaggtgtttccctactcgctagatggctgttgccagctccattttttgagcccgaggcctgcttttcttgttcaaaagagtagcaaagggttaggcattcaaaaatattctagcacccggctgagcctctctccttgacagtcgtcaggagaactgaaaaaggaatgactttctcactgcgttattcaaggttattttaagctccgtgtgaagttcgtgtcgcgttgcctctggctgggactggtatgcgagcctcatttcaggaaacacggcgttctttccctggctcctcatagctccgtggagtaggccgcgctattattgtcttttcattagaggaggaaatttaggctcagagaggtgaagccgctcgcccaaagtcacacagccgcgtcagccccgagcatgcgggctctccctgagttacccgctggatgttctttctcgtgttgaacgtcatgtgtttggatgggggcacagggcacagcaaggatacccccagtggccctctgccttcccacttgaggctcctcaggtgacagtgacctgcttcttcctgctcaggctttctggactcactggcttccttcccgtggggaaaggggaccgtcctcggctccagtctctccccgaggccgtcagagccagggccaggggcagcgtggactctgcctgcctctgtgggtgtggactcagtgtcgacagccccctctacaggagcatgaacacgctgacagggtgctggggtcggggggcagccctgggttcacgctccgccctcgcacccccagagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccgtctctccgggtctctgtttccccttttctgtgggtcactgtcctcatctctttgggtctgtgtttccgcttttctctgtgtctctgtccccgtctctctgggtctctgtctctgtctctctgggtctctgtctctgtctctctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctgtcgccatctctctgggtctctgtccctctctctctgggtctctgtccctctctctctgggtctttgtccccgtctctctgggtctctgtccccgtctctctgggtctctgtccctctctctctgggtctctgtcccatctctctgggtctctgtcccatgtctctgggtctctgtccctctctctctgggtctctgtcccatgtctctgggtctctgtccctctctctctgggtctctgtccccatctctctgggtctctgtccctctctctctgggtctctgtccctctctctctgggtctctgtccccatctctctgggtctctgtccctctctctctgggtctctgtccccgtctctctgggtctctgtccccgtctctctgggtctctgtccccgtctctctgggtctctgtccccctccctgtgtgccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggtgaccgagggtgggtgggggctgtctcctgggcctcggcctgcctgccatctcccccacgactgtgggtggcctcccccgccgcccagtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacccacaacccacgacccacaacctgcaaccccagcgctcaggatcccagtagtttggtctggtcgagatttggggaattacctatggttaagtgtctttccccgtcattattcatggttttaaaaacttctgtctgagagtgagttagctcacatcagtaatcccaacactttgggaggccgaggtaggaggattgcttgaggccagtaattcaagaccagcctgggtaacagagcaagaccttgtctctaccaataataataataataataataataaagaataaaaaataaattagccaggtgtggtgtcgtgtgcctgtaatcccagctacttgggaggctaaggtgagagaactgcttgaacccgggaggtggaggttgcagtgagccgagatcaagccactgcactccagcctgggcgacaaagcaatactccatctcaaacaaacaaacagactttattttgaaatttctcatacatacagaaaaatgcacgaaggtggacagcttgatgcatttttttctttttttgagacggagttttgccctgttgcccaggctggagtgcagtggcgcgatctcggctcactgcagcctctgcctcctgggttcaagcaattctcctgcctcagcctcctgcctcagactcctgagtagctgggattacaggcacgtgccatcacacccggctaatttttgtatttttagtagacggggtttcaccgtgttagccaggatggtcttgatctcctgaccttgtgatctgcctgctttggcctcccgaagtgctgggattacaggtgtgagccaccgcgcccggcctaatgtttgtatttttagtagagatgaggtttcaccttgttggctaggctgttttcgaacttctgacctcaagtgattcgcccacctcagcctcccaaagtgctaggattacagacgtgagccactgcacctggctccggctaatttttaaagttttttgtagagacagggttttgccatgcagcccaggtggcctcaaactcgtggtcgaaagtggtccacctgcctcagcctcccaaagtgctgggattacggtcgtgagccactgcgcccagccagccaatatcttataattttatcaaaacatgaacaagatacattactaggtttgaggaaagtttttgatttttgtgtatttttcttgtatcaatcctcttaccaaattttcttattgatctttatttttatttttggtggggttttccaattttctgggaatacaagccatgttttcttcaaataggtacttttgtcccttccagctttacaaaaaaccaaaaaccaaaaaatcaattttcacttcagtgatttcatttttttgcattattgagttagctcaaaactccaggatgaatacagtgttagtggtaatgtggtctagtttctaatttatttatttatttttttgagagggagtcctgctctgtgcacaggctggagtgcagtggcgtgatctcagctcactgcaacttctgcctcctaggttcaagcgtttttcctgcctcagcctcccgagtagctgggactataggcacgagccaccactcccagctaatttttgtatttttggtagagacggggtttcaccatgttggccaggctggtcttgaactcttgacctcaggtgatccacccgcctcggcctcccaaagtgctgggattacaggcatgagccaccgcacctggcctagtttctaattttaatggaagtagagtcgatatagtgctatctttatggtgcaattggattttggtaaatatctatattgtggttagatagccctttctattcccatttcctttactttctatttgaactttcactccctctggctcctggatggttaatcaatgacaggattgactcatacaagaaacacctgcctcattcagggactcaggagtctaggtcctcagccccctcctccctggggaagttaagcattactgtcttcaaaatctagctccctcctgaagtgtccaaagacatgacaattctggccaggcgcgctggctcacagctgtaatcccagcactttgggaggccaaggtgggaggatcccttgagtccaggaattcgagaccagcctgggcaagatggcaagacccctgtctctaccaaaaattaaaaagttagctgggcacggtggtgtgtgcctgtggtcccagctacttagaaggctaaagtaggaggatcaagatgtagtgaggtgtgatcatgcccctgcactctatcctgggcgatagagtgacaccctgtttcagaaattaggctgatgcggtggctcatgcctataatcccagcactttgggagtccaagttgggaggattgcttgaggccaggagttcgagaccaccctggccaacatagcaagacccccatttctaaaataaatacataattaagtaaaaaaagaaatgacaattccaatgagcctctgaacagaagattaggacaaggctgatgtttgccgactcctgggaaatgcggttttctcctatctccagcaaaggctgatgggaggtaatcaagcccccttctcttcttgcctcagggactggaattgacatccctgtcctgctcctcctgattgatggtgatgagaagatgttgacggtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtagcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtatgacactgggggcccaactctggatcctgagatgggagggaactggggacttgggctcctgggtctgagggaggaggggctgggggcctggacttccaggttccgggagaagagggtgctgggcatatagactattaggtcctggaggggaatggcctcctccatccctttggacagggcccaacaggagttggggatggaggcgggctagggatgcagaactggctattccacaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacacatccactgacaattccattcagtcattcttccatccatccatcttctcacctgtccatccatgcatccactgacaattcctgagaatgccatctgctcattcttccatccatccatcttctcacctgtccatctacacatccaccgaaaattcctgagaattccatccactcattcctccatccatccatcttctcacctgtccatccacacatccactgacaattccattcactcattcttccatccatccatcttctcacctgtccatccacacatccactgacaattcctgagaatgccatccgctcattcctccatccgtcttctcacctgtccatccacacatccactgacaattcctgagaattccatccgctcattcctccatccgtcttctcacctgtccatccacacatccactgacaattccatccacttattgttccatccatccatcttctcacctgtccatccacacatccactgaaaattccattcactcattcttccatccatccatcttctcacctgtccatccacacatccactgacaattccattcacttattcttccatccatccatcttctcacctgtccatccatgcatccactgacaattcctgagaatgccatctgctcattcttctatccatccatcttctcacctgtccatctgcacatccactgaaaattcctgagaattccatctactcattcctccatccatccatcttctcacctgtccatccacacatccactgacaattcctgagaattccatccgctcattcctccatccatccatcttctcacctgtccatccacacatccactgacaattccattcactcattcctccatccacccatcttccatccatttacccatctacccatccatcttttcattcatccatccaactgttcttccatctatccatccacccacccattcttccttccctacatgcttccaatatacatgaagcactctggctagacatgaaccaaagcactgtctcccagtgaggaagtccagatatttcactagaaatggcagcttggaggacggaatgatgaaaaccaaggcgggggagcataatgcacacctgggagaggctggggagggtcttatttatttattcacttattgagacagggtcttgctctgtaggccaagctggagtatagtggtgtgatcacggctcagtgcagcctcaacctcccaggctcaagtgatcctcccaccccagccttccaagtagctgggaacatacccgcccaccactacacctggtaaattaaacaaaaaaaaaattttttttttgtacagacgaggtcttgctctgttgcccatgctggtcatgaactcctggcctcaactgatcctcctgcctcagtctcccaaagtgctgggattacaggcatgagccaccatgccagcctcctttatttagtcaacaaatacaatcctaggctccagagactaaagccaacccatttcctgctctcaaagaccccagatcccactaggattgtttggatacaaccttaggtaaaatttaagacagaagcacaggcaagaatcactgtcgttagaaggaaaacttcaaggaaaagttgtgtgtgtgtgtgtgtgtgtattttgagacagagtcttgctctgtcgcccaggctggagtgcagtggtgcgagcttggctcactgcaacctccgcctcccgggttcaagcgattctcctgcctcaccctcctgagtagccgggattacaggcacgtgccatcatgcccggctgatttttgtatttttagtagagacggtgtttcaccatgttggtcaggctggcctcgaactcctgacctcatgatccatccacctcggcctcccaaagtgctgggattacaggtgtgagccactgcacctggccagagaagttggcatttaaaccggaccttggccaggcacagtggctcacacgtgtaatttcagcactttgggaggctgaggagggaagatcgcttgagcccaggagtttgagaccagcctgggcagcatggtgaaatgccacctctataaaaaatacaaataataagttggggagggtggcgcatacctgtaatcccagctacttgggtggctgaggcaggggaatcgctcgaacctaggaggcagattgtgccactgcactccagcctgggtgatagggcaagactctgtctcaaaaaaaaaaaaaaaaaacctaaataaataaaccaaataaactggaccttgataagtcagtagaatttggatttagtaagctaacgagtgggacagataagtattcaggaagattcccagggctctgtgtggggagggtcatttttggtgtcagaagaacttttttctttttttttttgagataaggcctcgctctgttgctcaggctggagtgcagtggtgtgatcttgacccactacagtcttgacctcctgggctcaagagatcctctcacctcagccccacaagtagctgggaccacaggcatgtgccatcatgcctggctttttttttttttttttttttttttgagacggagtttcgctcttgttgtccaggctggagtgcaatagtgccatctcagctcactgcaacctccgcctcccgggctcaagtgattctcctgcctcagcctcccaagtagctgggattacaggcatgcgccaccacacctggctaattttgtagttttagtagagatggggtttctccatattggtcaggctggtctcgaactcccgacctcgggtgatccgcccgcctcggcctcccaaagtgctgggattacaggcatgagccactgtgcccagccttttttgtatttttagtagagatggggtttcactatgttgcccaggctggtctcgaactcctgggctaaagctatctgcccatctcggcctcccaacgtgctgggattacaggcgtgagccattgtgcttaggccagaagaattttacgggggaaatacacactaagatagaaactccccagatacacggtggcaatatatacagcattctacctcagctccccacccatgtttgtggtgtggtatatattttaattatttttcttattttaattatttctttctttttcttttttttttttttgagacagagtctcgctctgtcgcccaggctggagtgcagtggcgcgatctcggctcgctgaaagctctgcctcctgggttcacgccattctcctccctcagcctcccgagtagttgggctctctatttttagtagagacggagtttcaccgtgttagccaggatggtctcgatctcctgaccttgtgatccacccgcctcggcctcccaaagtgctgggattacaggcgtgagccacggcgcccggcctcttttttttttttttttaaagagtctttgtctgtcgcccaggctggagtgcaatggcgccatctcagctcactgcaacctcctcctcccaggtttaagcgattctcctgcctcagcctcctgagtagctgggattacaggtgcccacaaccgcacccggctaatttttgtatttttagtacagacagggtttcgccatgttggccaggctggttttgaactcctgacctcaggtgatccacccgcctcggcctcccaaagtacttggattacaggtgtgagccaccgcgcccggccttaattcatttttaggtattttttgagacagtctcactctgttgtccaggctggagtgcagtgggacaatcatagctcactgcagccttgagatcctgggctcaagtgattctctcgcatcagcctctgagtagctgtgcgccaccacaccaggctaatttatttttaatttttttatagggatagggtctccctatgttgcctgggctggtcttgaactcttgggctgaagagatcctcctgccttgacctcccaaagtgctaggtatagtacaggctgtggtagggtagaaagagcaagttatttttgctttggaatcagacaaaactgaatttaaataccagcttgggccgggtacagtggctcacgcctataatcccaacattttgggaggctgaggtaggatcacttgaggtcaggagttcgagatcagcctggccaccatggcaaaaccctgtctctactgaaaatacaaaaattagctggcgtggtggcgggtgcctgtaatcccaactagttgggaggctgaggcaggagaatcgcttgaacccaggaggtggaggttgccgtgagccaagatcgtgccactgcactccagcctgggcgacagagcgagactctgtctcaaaaacaaacaatcaaaaagaaacaaaccagcttggccctttcttgctgtgtggtcttgaggaagcagcttcccctctctgagccccagtttctctctgtggaaagtggagataatatcttacaggagtgttataagcctccatggcaaggtatgagttgtgcccggtcccggtgggggcccaataagagggatctcctcttaatatgattccatttcctctgggggtacatccttcaatataaggtaactctcagtgggcaaatctgattcactctgcggaagttaactcagcagcctcctgggagaaaatacggcagctctgcaagatgtggtttgagggggtggtgttgtaagcccagcaggagtggaagtgatcacagtccactgggggaactggagatggctgataggcttggggatagcagagttgaatggatggaatttcagcaagaaagaagggcaaggtcatgaatgcgtcttttttttttttttttttttttgagacagtgtctcgctctgtcgcccaggctggagtgcagtggtgtgatctcagctcactgcaacccccgggttcaagcgattgtcctgcctcagcctcccgagaagctgggactacaggcacctgccactatgcctggctaatgtttgtatttttagtagagatggggtttcaccatgttggccaggatggtctcgaccttctgacctcgtgatctgcctgcctcggcctcccaaagtgctgggattacaggtgtgagccaccacccctggcccatgaatccttcctaagagtctagcataggcaggcccagtgctgggcagttggtgtactcttttgcccttcatctcccttccctgcctgcaaggattatcaccccattttgcagatgaagagactgaggctcagagagaggaaaaatggcttgcccagggtcatccagctagtagcaggggtcaggcttttcatgtgagtctgtataattctcaagcccattgcaaggggcatgtttggagagaggtcagaggctcgcagggttggtatgtatcattggcatgaagggagtgttggagacaaggccagtgaggcaggtagggccaaaccacccaggacctcaaatgccaggcagaggggctaaggctgtccttgagaggcagcagaggaccagggtccgttatgtggataaaaaagactctctggccaagcgtgaaggctcatgcctattatcacagcaccttggaagactaaggaaggaggttcgcttgagcccaggagtttgagaccagcctgggcagcatagtgagaccccatgtctataaaaaattagctgggtatggtactgtgcgcctgtagtcccagctactcgggaggctgaggcaggaggatcgcttgagcctgggaggtctcaaagctgaagtgagctgtgatggcgccactgcactccagactgggtgacagacgaagaccctgtctcaaaaaacaaaaacagactctctgggagtgggtgggggcagagtggagaggagagaagagactgcagtgatggtgtttgggggtgccgaagcttgagctatagctggggccaggaggacagtcggggaggctcagcagagagtcaggaggctggacgtgggacatgaagcttgggggctgatggcctgtgagatgggaggagcaggaagggacaaggacagtacctgcgggtctgccttattgattgggtggacagaggggccattcctgagatgaggacgtagggaagatgggtttgagggctagatgctgagttgagtatggaacacggtgagtctgaagggacaaggtggggccagggtcgagtgcccaggtgacaaatggtgccagattaaggcggaatataaagcaaggtattattattattattatttttatttttttattttttttgagatggagtcttgctctgtcgtccaggctggagtgcagtggcacgatcttggctcactacaagctccacctcccaggttcatgccatcctcctgcctcagcctcctgagtagctggcactacaggcgcccgccaccatgcccggctaattttttgtatatttagtagagatggggtttcactgtgttaaccagggtggtctcgatctcttgacctcatgatccacccatctcggcctcccaaagtgctgggattacaggtgtgagccactgtgcccggcctattattattatttttgcaacagagtttcgctctgttgcccaggctggagtgcaatggcgtgatcttggctcactgcaacctccacctcccgggttcaagcgattttcctgcctcagcctcccaagtagctgggattacaggcatgagccaccacgcccagctaattttgtatttttagcagagacgaggtttctccatgttggtcaggctggtctcgaactcctgacctcaggtgattcgcccacctcggcctcccaaggtgttgggattacaggcatgagccacagcatccagcctattattattatttgagacggagtctccctttctcacccaggctggaatgcagtgacgtgatctcggctcactgcaacctccacctcccgggttcaagcgattctcctgctcagcctcccaagtagctgggactacagacgcatgccaccatgcccagctaattttttgtattttagtagagatggggtttcaccgtgttacccaggctggtctcgaactcctgagctcaggcgatccgcccatcttggcctcccaaagtgctgggattacaggcgtgagccacggcgcccggcctgtaaagcaagatattatgaacaattttgtttccttcttttgaaactgtggggaaagtaggagagcttcatagaatcgtagaaagtcgtggaaaagtccgctctgaatggacgtctgggttttgaaagagcacagaaagccatgaggtcctagacatgttactgcctttctgggcctctgtttcctcaagcacagccttggaggttacactggccaagctgtagtgtcgccacagcgtggaacttcttcccacagttactgtaattgattacagtgctatgaagggggtgccactatttcccatttaatagatgaggaaactgaggctcccaaggttcaatggcttgcctgaagtcactcagttggtactggtggaccggggactggaacccacgtctgcctgccccagagcctattgctcacctccactacatgagattatctctttctgtggtaccagtttttggagcaaccaaaatgagatgaatttgttttggagatagatatggagcaagtggaggcagaaggaaacctaactccatgtcacgacaaatgcccttcaggacttttcatgcccctgttgactgcacatgtttggatccactacatagctggatcaaatttttaagggtttctggttctctcttgctgtttcagtgacctccagggtctctcggagtccctctcctgttctcattttctgctgttgtcacctctttcccttcacaatataccccaagtttcagaaatcagagtgactcacgtttgtcatcatctgctgtgtgtgtgtgtgtgtgtgtgtgtgtgtgtgtgtgtgtgtgtgtgtgttgcacccgggcctttgcttctgctgtgcctgctgctttgaacgcccttttcgcaccttaggggcatacctcccagtcctggtggtctttcaaagtgctacctcaacacccattctctgggagctctcttgggccactctatacctctgtgaccatatcctcctctgggccctaatcatattatatgcctatagatgcctccttagacacccctccaccctgccttccattatggcctgtccagccttccctttaatcgcccatccatctctgattgtccgtctgccccatcttgtttcctctctccccatccatccgtctgtccatctatccatctatccaccctgtacatccatctatccatccatccgttcattcatccatctctttatcctttcatccatccatttatccatcccatccatccatccttctatctgtccatccatccatcctaatcatattatatgcctacctctgagggcaccaagcaccctgagggtagttatgtgttggggggacatatttcccccaatagaaccagcttcttcagggtaggaactgtatctgatttctctctccatccctcccactgcttggtccataacatacctcaataaatattaaatgaataagtgattccttttgtttcttcttgggggctgtaaaccagtggtctgtgctctggccctgagccaaatgaccttatgcctatgatagcctgactgctttaagacccccacactctgcccagtagcaacccctttatgcagagtttaaaagtcagacatgcaaaatagaggcaaaatagacattcagcagatgtccctcctcccctgacttcttgtcccctctccctctaatccttccagcctgtgggagctcggaggcctcagcctacctggatgagctgcgtttggctgtggcttggaaccgcgtggacattgcccagagtgaactctttcggggggacatccaatggcgggtgaggggtcagggcctgggggttgggcatactgacaaagggactgtgctgtcctccctctctgccttctttttttttttttttttttttgacggagtctcactctgtcacccagcctggagtgcagaggtgtgatcccagctcactgcaagctccgccacctgggttcacgccattctcctgcctcagcctcccgagtagctgggactacaggcgcccgccaccacacccagctaatttttttgtatttttagtagagacggggtttcactatgttagccaggatggtctcgatctcctgaccttgtgatccgcccgcctcaggctcccaaagtgctggggttacaggcatgagccaccgcacccggcctctctgccttcttagacgcccctcaaccctgccttccattatggcctgtccagccttcccttaattgtccatccatctctgtccatctgccccatcttgtttcctctctccccacccatccatctgtctatccatccatccaccctgtacctccatctatccattcatccattcattcatccatctacttatccatccatccatccatttgtccatccatccatttatccatccatccatccatccatccatccatccatctgtccatccatccatccatccatccatccatccatctgtccattcatccatccatccattcatctgtccatccatccatctacctatccattcatccatacatccatccatctacctatccattcatccatccatccatccatctatccatccatccatctgtccatccattcatctgtccatccatccatctacctatccgttcatccatccatccctctgtccatccatccatccctctgtccatccatccatccctctgtccatccatccatccatccatccatccatccatccatctgcccatccatccatctgtccatccatccatctacctatccattcatccatccatccacccatccatccatccatccatccatccatccatccatccatccatccatccgtccctcatacccttgcccatctcttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcgtaaggaccgggcaaagctggggggcccccccgcgcgggaaggacctgggggcgggattacatcagggatggggcgtggccaaaccagaggcagggctggtggtggccagtgttggggaggggctggtcctcaccacccctccttttgctggcagatgtatctgctctcggacaaggccacctcgccgctctcgctggatgctggcctcgggcaggccccctggagcgacctgcttctttgggcactgttgctgaacagggcacagatggccatgtacttctgggagatggtgagtgctgacttggcgctcctgcatccctgtcctttaggccactggatgccagtgttcccgaaacaattaccatacaattccccgacccctgacgtcacctgacaggcgccccatcctccgtcgctgatatatgcctccaactgcttcctctttcttttctctctctcacatcatgcattattttatgtgtttattttttgagacagagtctcgctctgtcgcccaggctgcagtgcagtggcgcaatcttggcttactgcaccctcagtctcccgggttcaagtaattctcctgcctcagcctccggagtagctgggattacaggcacctgcccccacgcctggctaatttttgttttgttttgttttgttttagtagagatggggtttcaccatgttggccaggctggactcctgacctcaagtgatccacccgcctcggcttcccaaaatgctgggattacaggcatgtgccaccgtgcctggccaagattctctctttgttttggcctttgataatatatctcagtgtggatctctgtgaatttctttttctttttcttttttttttttttttgagatggagtcctgctctgttgcccaggctggagtgcagtggcatgatctcggctcactgcaagctccaccttctgggttcatgccattctcctgcctcagcctcccgagtagctgggactacaggcgcccgccaccacgcccagctaattttttgtatttttagtagagatggggtttcaccgtggtcttgatctcctgaccttgtgatctgtctgccttggcctcccgaagtgctgggattacaggcgtgagccactgtgcttggcctgtgaatttcttttacttggagttccttgagcttcctggatgtgtagacttttgtctttcatcacattttggaagtttttaggacattatatcttcaaatattatttctttccctttctgtctctcttttccttttggactctcattatgtatgtattaatattctgtatggtgtctcgcaagtcccttaggctctgcttattttccttcatttgtttttcttttttctcctcaggctggataatctcaatgtacttagcttcaaattcactgatctttattttgccttttttatgaatctactgttgagtccctctagtggtttttatatttcagttattgtgctttttagcttcagagtttctatttggttcatttctgtctctgtagtcttttttttttttttttttttttttttgagacagagtctcgctcagtcgcccaggctggagtgcagtggctcaatctccgctcactgcaagctctgcctcctgggttcacgccattctcctgcctccacgccattctcctgcctcagcctcccaagtagctgggactacaggtgcccgccaccacgcccagctaatttttttgtatttttttagagacagggtttcactgtgttagccaggatggttgcgatctcctgacctcgtgatctgccctcctcggcctcccaaagtgctgggattacaggcgtgagccactgcgcccggcctctgtagtctgtcttttttttttcctggtcccactacaaaactttatttttgattacagtaccattctcaatctcttctacaaaaagcagaaaaaaaagcagccacttcactcaagacctatatacagataagatgttttctgtgtttttttcttttttttttaatttttatttttaaaaaaataaattcagtgttcacatttctataaagaattaacccagtttcaggaaaccctgcctctatctctgtattcttattctctaggtggtgagacatctttttcctggctccctttagttcttttttcatgatttcctttagctcttcgagcatatttaagacaatttatttaaagcctttgctagtaagttcagtgtctgagtttcctcagggatagtttctattcatttatttttttcctactcatttctattcatttcatttcttttcttttatttatttatttgttgttcttgttgttgttgttgagacagagtctcattctgtcactcagactggactgcagtggtttgaccaaagttcactgcaaccttgacttcttggactcaagcaatcctcccacctcagcctcctgagtagttgggtctaccagccacatgccaagctaattttaaaaaatttgcagagatggggtcttactatgttgcccaggttggtcttgaattcttgggctcaagcaatcctcctgcctgggcctcccaaagtgctgggattacaggtgtgagccaccatgcctggtctctattaatttcttttttttccagtatatgaaccatattgtcttgtttctttgcatgcctcataatttttggttgaaaagtggaacattttgaatatgataatgtggcaactctggaaatcagcttatgccctccctccagggtttgttgtggctgctgctcattgtgggtcattgttgtttgtttagtgacttttcttttttctttttcttttttttggggggaggggggatggagtctcactctgtggcccaggctagagtacagtggtgcaatctcggctcactgcaagctccacctcccaggtttaagtgattctcctgcctcagcctcccaagtagctgggattacaggtgtgtgccaccacacccagctaatttttgtatttttcatagagacggggtttcaccatgttagccaggctggtctcaaactcctgacctcaggtgatccacccaccttggcctcccaaagtgttaggattacaggcgtgagccaccgcgcccaccctgtttagtgacttctctaaaccttttttggaaagtctgtattctttgcatgtgtggccatggaagcccctcttctgttagcttagtggtctgctggtgacttgacagagatatccttaaatgcctagaaccacagaagcaaatataacaagaaactccctataagtgctgggattagaggcatgagcgacgcccaccgtggctgtatattgaagcagtctttcaatacttagccaagctgtttacagttctgctttagtcttcacttcctgcttgtgcagagcctaaagttcagccagatgtaagagcttcaggttttctctggtattttctgagcacgcctctagccctagtcatgcatctagccgtctggatttcctggtacacaaggaagactttcaaagcccttattccctccaagtatttcctttcatggcctctttcttcccaagatgcttagtgtatctattactgcctctactgtgagtccttgcctcagatggatgtggttaattcatttgcctttaaaagattttaacaggccgggtgcagtggctcacacctgtaatcccagcactttgggaggccgaggcaggtggatcgcctgaggtcaggagttcgagaccagcctgaccaacatggagaaaccctatctctactaaaagcacaaaaaattagcctggcatggtggcgcatatctgtaattccagctactcgggaggctgaggcaggagaattgcttgaacctcggaggcagaggttgtggtgggctgagattgcagcattgcactccagcctgggcaacaagagtgaaactccgtctcaaaaaaaaaaaaaaagattttaacacacactgcctggaaagccactttttctctggggaaagctctaaggcaggtgaagcaaagtcaagtccttgagctgttgcttcagggagccaccagatagggccacacacacaaccacaattctggagggtaagtctgaattgctccctctagtactagcgacccacaccaggaatgtgtgtctttgtcttcaaggttgccactgaactggggagctgggggtagtaagtgggtaggttaaaatgtcacagtaccctcttactgaaatttagtggtctcttcattaagcattttcttgtttttttttttttataagttttcgattagattccagaattctagaaaagttgattctgacaacttttgatagctattgattgcttttgtggagggataaagttttgaagttccctacactggcatttttggtcacctctccaagggcttttaaaaatttcattgttagagacagggtcttcctcagtcatccaggctggagtgcagtggcatgatcatggctcactgcagcctcaacctactgggctcattcgatcctcctacctcagcttccctagtagctgggactacagaagcagaccaccacgcctggctaactaaaaaaaaaaaaattttgtagagatggagtctcaccatgttgcctggctggtcttgaattcctgggctcaagcaatcctcctcatttgtaaccacccaatgggttcacgttgcccgctgcctagacagagccgatttatcaaaacaaggaaagtgtaatggagaaagagtaattcgcgcagagccggctgtgcgggagacctcagttttattatcactcaaatcagtctcctcgaggattcagggatcagagcttttaaagataatttggtgggtagaggcttgggaagtggggagtgctgattggtcaggttggagatggaatcacaggggttggaagtgaggtttttcttgctgttttctgttcctgggtgggatggcagaactggttgagccagactacagtctgggtggtgtcagctgatccatccagtgcagggtctgcaaactatctcaagcactcatcttaggtgttacagtaatgatgttatccccaggagcaattgggggagccagaggctgcgtgacccctaaacttaatttctaatcttgtagctaatttgttagtcctgcaaaggtagactggtccccaggcaagatgggggtctttggggaaagggctattatcaatttcgtttcagagtcaaaccatgaacagaattccttcccaaagttagttcagcctatgcccaggaatgagcgaggacagcttaagggttagaagcaagatggagtcggttaggtctgatttctttcattgtcataattttctcagttatcatttttgcaaaggtggtttcacttcagcctcccaacgtgctgggattatagtcgtgagccactttacccagcctccaactgcttcttgacctgtctgtgactgctgaattgattctaactgcagcccagcccctgacttgcatccctggtctctgaaccacctgacttctggcattttcaactgactttcagtttcttccagatccatctccaaacattacttcatccttggcctctgatgaccccagttagtttctgacctctgactctgttccttcccttgacttcaggcttcctccccctctatgaaccctctttgacgcatccgtgccctctttgtctctccagggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacaggtgagtatctgcgacaccaacatcccaaacagtctccaagtggactctgggaagtatggggatgagcccctgccattgggaacatctatggtcttgaccagccactctccctggagatcccccagaaagtctctcttctctctcagaaaggctgctcttcccataagaagccccgctcccttccaccaaaagccaaccttcccacggcaaagcccatcttcctaaaaagttccactccagatagagaaactccttgtgaccctgtcaggaaattccacctttaaccttggaagtccttcccgctttcagggaagagtccatttctttcaaaggaagtcctagctcatccacaggaagtcctacggcatccacaggaagtcctttccacttcctttagaggtccctagtttcagttttcagcagttagaatggcctcactgaacaattacctttttttttttttggacataaacaaactttggtctaggaaatctcacccttcctataggaaatcatctgccttgggaagccctacttgctcccacagtctctccgatcctgacaagttgacattttggaaacattatcaatatttttagtttaaatctgacaggggctcagagtcccactttagtacaggaagttgtgcccaacaggaagtcccatcctcatctgttggaatggtttggctgacatttcaaacagctacccagagtcccttgctgtggatagtggttaaactcatggattccagctctaccacatacaaactgtgtttctttgggccgtttccttaacctctctgtgcctcatgtgtaccaaggaggagatactagtacccacccccttatgtgtcaagggttcggtggactaatctacataaagtgcttagccctgtatctgccatatggtgtcaatttaagtgttgactgtttactgccaaaacctggcctaagttgtctttgcctttcaccaccgtttccctacctcaatagttgtggctgtgacattgggcacttgctctgtactctggagctgcagtccaacccttgctgggcgtcttagggacggggctgtgggggagatttggatcctaatccttcccaccccccacagtctctgctgacacagaagtggtggggagatatggccagcactacacccatctgggccctggttctcgccttcttttgccctccactcatctacacccgcctcatcaccttcaggtcagtaccctggggtgagagtggtggggatgggggcggggtgctcagtttctccttcctgccccctctgcccacctttcttccctcatcggcccattgtgtcccttccctaggaatgggactctctgtccctccactaagggagtgctgtgggaggtgagttttgggggggatcctccctgtggtatctctagtggcagttactctgcctttctggccatggctctgggggaaggtccctttgggatgactttaggagaccacctctctgtccctctgccatgtctccgggtgaagaagtttgagttttgctggagaatgcctctccaccttctcttcccctcatttcttgctctgtgcttccccccttgctaggaaatcagaagaggagcccacacgggaggagctagagtttgacatggatagtgtcattaatggggaagggcctgtcgggtgagtggagcctccagcactgtgtgaggtggggacaccctgggcagttcaggacatgtgccagttccacgttgtgttagtcccctcttgagttgctacaaagttgctaaacctgagactgagtaatttataaagaaaagaggtttcattggctcatggttctgcaggttgtacaggaagcatagtgctggcatctgcggctggtgagccctcaggaagcttccactcatggcagaaagtgagggaggagccagtgtatcacatggcgagagcagaagcaggagtaggggtgccacatagatctcatgtgaactaactgagcaaaaagtctccaaagggatggtgctgagccatttgtgaaggacccaccaccaggacccaaacacttcccccaggccccacctccaacattagggattacatttctttgttctttttttctttttttttgatacggagtctccctcagttgcccaggctggagtgcagtggtacaatcttggctcactgcagcctctgtttcctgggttcctgatcagcctgcctcagcctcccaagtaggtgggagtagaagtgcatgccactacgcccagctaatttttgtatctttaaagtagagtcgggatttcaccatgttggccaggctggtgtcaacctcctgacctcaagtgatccgcgcactttggcctcccaaagtgctgggattacaggtgtgagccaccgggcccagccagggattacatttctttctttcttttttgaaatggggtctcgctctgtcgaccaggctggagtgcagtggtgtgatctccgcctcctgggttcaagcgattctcctgcctcagcctcccgaatagctgggactacaggagcccaccaccacacctggctaacttttgtacttttagtagtgacagggtttcatcacattggccaggctggtcttgaactcctgaccttgtgatccgcccgcctcagcctcccaaagtactgggattacaggcatgagccaccatgcctggcccagggattacatttcaatgtgagatttggaagggacaaacatccaaactatatcacacgtcccatcagggactgagatactgaggaagcttcccaggtgccaagctcaagacttggctcaagatttggttctgccatcaaggaggccatcaccagaaattgattttcttcatgctacacatacttccatccctctgtagcaagcggaatcagttgattgagggatttttcacctattttgttcgtggtcccaaggcccctgcttttaatcactatgctatggttgccgttaaggtattttaaaagtcaggcctaagcaaatgaaatagaatatttatcaaacttctttttttgttgttgtttttgaggcggagtcttgctctgtcgccaggcaggagtgcggtgccgcgatctcatctcactgcaacctccgcctcctgagttcaagcgattctcctgcctcagcctctcaagtagctgggattacagtcacctgccaccacgcccagctaatttttttgtatttttagtagagacggggtttcaccatgttggccaggatgctccccatctcctgactttgtgatctgtcctcctcagcctcccaaaatgctgggattacaggcatgagccaccatgcctggcctatatatagttttttaagacaatgtagagaggatacaaaatatttatctgtagccataaaaaagaacgagatcatttcctttgcagtgacatggttggagctggaggccattatccataacaaattaacaggaacagaaaaccaaataccccatgttctcacttataagtaagaactaaatgatgagaacacatggacacacagagtgaaacaacacacattggggcctattggaggacagagggtagggcgagggagaggaccaggaaaaataactagtgggtactaggctaaatacctgggtgatggaataatctgtacaacaaacccccatgacacaaatttacctacctaacaaacctgcacatgtacctctgaactaaaaataaacgtcaaaaaataaaaaaaagaacaaaatatgtatcaagagagaagggaaaaactaagataaacatttggaccactgagaaaggttgatagaaggccccagtgtctgaggtcaggatcagtaatggtgtccttccctagcaatttctcatctgcacatgtgatgatgatgacgaccttgataacagctgatgttatgaaacacgtacaatgagcaactactgtgctcaattcttttgaaaatcagttggttttttttttttttttttgagatggagtcttactctgtcgcccaggctggagtgcagtggcatgatctcggctcactgcaagctcctcctcccgggttcacaccattctcctgcctcagcctcctgagtagctgggactacaggtgcccgccaccacgcccggctaatttttttgtatttttagtagagctggggtttccccgtgttagccaggatggtctcgatctcctgacctcgtgatctgcccgcctcggcctcccaaagtgctgggattacaagcatgagccaccgcacccgtccggaaatcagttcgtttaattccaacaacccagtgcaatagggcctataattattctcattttgcaggtgaaataatggagtcattcagtcacttgcctcagatcatgtggttggtaaatggtagagccgagatttgatcccagatcctcttgtacctgagtctgtgctctcagcccctgtggagcccccccactgagagctctgttgaaggacagatcccaagatccccccagagaggctggggctgagcccaggaacctgcctgtggcctggctggaggtgattcaagatggcagatgtgggggaagctttctgacccaccgctctcccttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttttctttctttctttctttctttctttctttctttctttctttctttctttctttctctctctttcttttctttctttctcttttcttttcctttcttttctttttctttttctcttttctttctctctctctccctctgtcctctgcccctctgcctccctccctccttccttccttccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccgctgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttggtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctccccaaacccaaccagaccctgcttgtaatttggactttggactgatcctctccctgagcccaggttgaacttccttatttgtatttttttgagacagggtctcactctgtcgccaaggctagagtgtggtgatgtgatcgtagcttactgcagcctcgacctcctggactcaagcaatcctcctgccttcgccccataagtagctgggactacttaaaattagccaggccagcaggcctgcctaatttaaaaaaatttttggagagaggggtctcactatgttgtccatgctagtctcgagctcctggactcaagtgatcctccctcctcagcctcccaaagtgctgggataatctgtcacctaggctggagtgtagtggcaagttctcagctcactgcaacctccacttcccactcccccatacccagttaattttttgtatttgtagtagagatagggtttcaccatgttggccttgaactcttgacctcaagtgattggcccacctcagcctcccaaagtgttgggattacaggtgtgagccatcgcgcccagccaactttgttttttattgtggtaaaattatataaaattttccatttttacttctttttttttttttttttttttgacggagtctcgctgtgtcacccaggctagagtgcagtggcacgatctcacaatctcagctcactacaagctccgccacccgggttcacgccattctcctacctcagcctcctgagtagctgggactacaggtgcccgccaccacgcccagctaatttttttgtatttttagtagagacggagtttcaccgtgttaacccggatggtctcaatctcctgacctcgtgatccacccgccttggcctcccaaagtgctaggattacaggcgtgagccaccgcgccccgcctttttttgagatggagtctcgctctgtcgcccaggctggagtgcaatggtgcaatctcagcttactgcaacctccacctcccaggttcaagcgattctcctgcctcagcctcccaagtagctaggactacaggcgtgcgccaccacacctggctaattttttgtatttttagtagagatggggtttcaccgtgttagccaggatggtttcgatctcctgaccttgtgatccgcccgccttggcctcccagagtgctgggattactgacatgagccaccgcggccggagttgatttttaccatttttaagtgtacaagtcagtgacattaattacatttacagtactctccaaccatcaccactatctattttcaatacgttctatcacccagaacagaaagtgtgtccccatgaaacagcaactccccacttcccctccccacaggtcttagtaacctccagtgtattttctgtctctatggatttagtctagatgtttcatgtaagtggaattatgcgatatttgtcttttggtgtctggctgattttactgagcatgttttcaaggctcatccctgttgtagtgtgcatcagaacttcattcattccgttttatgaatgagtaatattctattgtacaaatagaccacatttgggcccagcgtggtggctcatgcctgtaatcccagcactttgggaggcctaggcgggtggatcacctgaggtcaggagttcgagaccagcctggccaacgtggcaggaccccctttttactaaaaatacaaaaattagctgggctcatgtctgtaattccagctacttgggaggctcaggcacgagagtcgcttgaacccaggaggcggaggctacagtgagccaagatcgtgccactgcactccagcctgggcaacagagcgagactccatctcaaaaaaagaagaccacatttgatttacccgctcatctgttgatgaacacttgggttctttctgccttttggctattgtgactaatgtttgttggaacattggcatgcaagtatctatttgaatccttgtttttatttcctttgggtgtgtatctcaaagtggaattcctcggtcatgtggtaattctatgtatagctttttgagaaaccaccaaactggtttccacagcagctgcaccattttccattctcaccagcagtgtatgagggttttaatttctccacatcctagccaacacttgttattttccttttgtaaaaattatagtcatccagctgggtgtagtggctcatgcctgtaatcccagcactttggggggctgaggtgggaggattgcttgagcacaagagttcgagaccagcctgggcaacatagcgaggctgctgtctctaccaaaacaccagaaatgagataccacttcacacctgcagcctcaacctcctgggctcaagtgatcctcccacctcagcctcccaagtagctgggactacagttacgtgccaccatacctggcttgtttttttaattttttttttacttttattttatttatttatttttagtagaaacggggtttcaccatgttatccaggatggtctcgatctcctgaccttgtgatccacccatctcggctggatcccaaagtgctgggattacaggcgtgagccaccgtgcccagcggctattttttttttttttaatgaaactcctttttaatcctatgttaggtctctctgtttgcttcctttcttgttggcatgatttttgctgagaaaatataaaatttcattggctttggttgtttttttttttttttttttttcagagatggggtcttactatattgcccaggctgatcttgaacccctgggctcaagcagtcctcttgccttggccttccaaagtgctgggattataggcacaagcccctgtgctggacctattgtattagtttcctagggccgccagagtaccaaaaactgtgtggctttaaatcacagaaattgtctcacaattctggatgctagaggtccaaaatcaaggcatccgtcaagctgttttcttctgagggatgtcggggagagtctgttccatgcccctcctgtcacgtctagtgctttgctggccatctttggcttctagttgcgtcattgaaacttctgctttcatcttccagatttccccttttaataaaacgttacttaaattggattagggaccatgctaataacttcattttaacttgatcacatgtgtaaactctatttccgaataaagccacatatttcataaataaaaaatttaaaaaggtctcattctgaggcactatgggttatgacttcaacttttttttttttttttttttttttttggagacagagtcttgctctgtcacccaggttggagtgcaatggcgtgatctcggctcactgcaacctccacctcctgggttcaagggattctcctgcctcagcctcccgagtagctgggattacaggtgcctgccactatacacagctaatttttgtatttttagtagggacggggtttcaccatgttgcccaggccgatctcaaactcctgacctcaggtgatgcacctgcctcggcctcccaaagtgctgggattacagccgtgagccactggacccggccggacttcaacatatctttagcgggatacaattcaatgcatgacactcatagatttatgagtttatttctggactttcaattctattccactggattgcgtctatccttatgccagaaccacacagttttttgggttttttttgagacggagtctcgctcttgtcacccaggcgggattgcagtggcacgatctctgctcactgcaacatccgcatcctggattcaaacgattctcctaactcagcctcctgagtagctgggattacaggcacctgccaccacgcccggctaatttttttgtatttttggtagagacagggtttcaccatgttggccaggctagtcttgaactcctgacctcaggtgatctgcctcggctttccaaggtgctgggattacaggcgtgagccaccatgtctagcccacacagtgttgattactgtaggtttgtagcaaattttgacattggaagtatgagtctcctttgttatttttcaagattgttttggctattctgggcctcctgcaattctatatgaacttaaagatcagagtttccatgtctgtcaaaaaggttgttggaattttctttttttttccttttttttttttcttttttttgagacagagtttcactcttgttgcccaggctggagtgcaatggcgcgatctcagctcaccacaacctctgcctcccgggctcaagcgattctcctgcctcagcctcctgagtagctgggcttataggcatgtgccaccacgcccggctaattttgtatttttagtagagacagggtttctccatgttggtcaggctggtctcgaactcccgacctcaggtgatccacccgccttggcctcccaaagttctgggattacaggtgtgagccaccgcgcccggccagttgttggaattttccgagggattgcgttgaatctgtagattgcttcgggtagtattgatatttcatctaggtgttctttttaatgcttttccagcagtatttggtagttttcaggctacaaattgttcacccttttggttaactttattcctaggtgcttaacctttagatactgttgtaagtggaattgctttcttaatttcctttttggattgttcattgcgggtgtgtagaaacacaactgatttttgtgtgatcttgtaccctgcaactttgctgaatctgcagccctagaagctttcttgtgattctctggcatttcctatatataggatcatgtcatctgtgaatagagatatttttacttcttcctttccaatttggatgccttttattttttttcttgtttaattgttctagccagaacttccagcacaatgtggaatagcagtggtaaaagtggacatccttgtcttgtccctgatcttaggcagaaagctttcactctttcaccattgggtatgacggtagctgtgggtttttcagaagtaccttttctcatgttgagaaagtttatttctattcctagtttacgatttttaaaaattatgatgcatggtggcttgtgcctgcaatcacaatactttagggagccaaagtgggaggatcacttgaggccaggagttcaagaccgacctgggcaacatagtgagaccttatctcaataaaaaaataaaaaatttgccaggcgtggtggtgcatgcctgtagtcccagctactcaagaggctgaggtgggaggaaggcttgagcccaggaggtcaaggctgtggcttcagtgagccatgatttcaccaccatcatgattgtgccaccaacagagtgaaaccttgtctcaaaaaaaaaaaaaaaaaaaaaaagccatgcatggtggctcaagcctgcaatcccagcactttgggaggccgaggtgggcagatcatgaggtcaggagatcgagaccatcctggctaacacggttgtaggggccagccctacaaggtctgtgggtttttctccccgtgtgcagagacaagagattgtagaaatgaagacacaagacaaagagatcaaagaaaagacagctgggcctgggggaccactaccaccaagacgtggagaccgacagtggcccctaatgcctggctgcgctgttatttattggatacaaagcaaaaggggcagggtaaagagtgtgagtcatctccaatgattgataaggtcacgtgagtcacatgtccactggacaggggcccttccctgttaggtagccaaggcggagagagagaggacagcttacatcattatttcttctatgctcttttaagaaagatcaaagactttaatactttaatactttcactaattttgctactgctatctagagggcagagccagctgtacagagtggaacatgaaagtgaaacaggagtgtgaccgctgaagcacagcatcacagggagacggttaggcccctggataactgcgggcgggcctgacatcagtcaggccctccacaagaggtggtggagcagtcttctctaaactcccccggggaaagggagactccctttcccggtctgctaagtagtgggtgcttttccttggcactgacgctacctctagaccacggtccgcttggtaacgggaatcttcccagatgctggcgttaccgctagaccaaggagccctctggtggccctgtccaggaataacagaaggctcacactctgtcttctggtcacttctcatcatgccccttcagctcctatctctgtatggcttggtttttcctaggttatgattgtaaagcaaggattattataatattgaaataaagagtaattgctacaaactaatgattgatattcatatataatcatatctatgatctatatctagtataactcttgttattttatatgttttattacactggaacagcttgtgccctcggtctcttgccttggcacctgggtggcttgccgcccacacatggtgaaaccccatctttactaaaaatacaaaaagttagctgagcgtggtggtgggtgcctgtagtcccagctactcaggaggctgaggcaagagaatggcatgaacccaggaggcggagcttgcagtgagccgagattgtgccactgcactccagcctgtgggacagagcaagactccatcaaaaaaaaaaaaaaaaaatcgtgaagtgttgttgaattttgtcaaatgccttttctgtgttggttgagaagatcatatggcttcccccacaccttgttctattaatttggtgtttgcattaatttttgtatgtttaactacccttactttcctaggataaatcccatttcgttatggtataaaatccacttaatgtgctgctgaattagatttgcttgtattttttcaggatgtttacatgtatattcataagggctactgctctgtaattttcttgtgatatctttatctggctttggtattacggtaatgctggcctcatagaatgagttaggaaatgttctctccttttcaatcttttggacgaatttgagaaacatccttgttattataattcttctttaaatatttgatagaattcaccagcacagccatctggttttgggcttttctttattgaaacgtttttgattcaatctcttatgataattctactgagattttctgttttttcttgagtcagcttagctaatttgtgtgttcctaggaatttgtccatttcatttatctagtttgttgacatataattgttgatagtattctcatacaatcctttttatttcggtaaggtcagtagtaatgtctccattttcatttctgatgttagttatttgtgtccaggctaactttggagcccaactttaacctgacttcaacctccaccttataccgtgataccatcccaacttgacctctgacatctgacccttggcccttctaaactgactttttttttttttttttttttttgagatggagtcttactctgtctcccaggctggagtgcagtggcacgatctcagctcactgcaacctccacctcctgggttcaagcgattctcctgcctcagcctccccagtagctgggattacaggtgcccaccaccacgcctggctaatttttgtatttttagtagagatggggcttcaccatgttagccaggctggtctcgaactcctgacctgaggtgatccgcccactccggcctcccaaagtgctgggactacaggcgtgaccaaacgcccttggctctaacctgacttctaatcgcatcctgtaacctctgactttagtgatcttgacttctgtctgctgctatagactgaacaattattgcctggcatctaaccttcgtccttgcccctggctgggccctgacctcaagtgacctttgacctctggcctttgcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgtaagaacagagcttggcttaaaaaggagaaatataggggaccgggagcctggaaggcgaggggaagggggcatgccccaaatgactaacgggcgtggcttaggtagcgaggggcggggtttaagcaacaaggggcggagcttaagcactgaggggcagtgcttacgggtgaggggcggggcatgttctcgaatcaccaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaagtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcagggtggacttggcactgaaacagctgggacacatccgcgagtacgaacagcgcctgaaagtgctggagcgggaggtgaggccttggggcctggctgggggactgtggcaggggtcccatctcccgctctgacattcctcccattccgcaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtg

SEQ ID NO: 2606 - DNA, 54084 bp, Homo sapiens; identical to SEQ ID NO: 2605

SEQ ID NO: 2607 - DNA, 55258 bp, Homo sapiens
agtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccggtgagccctgtcctggcctcgcgcgcagcacaccggaccggcgctaggcctccgcgtaggcctggcctgcacgggcgggcacccggcatggactgggaggggccggggtggggtgcgcggggccggcggcgcggagatgacccaggcaccgtcccctctcccggctgggtcggagccctgcgtggcaggggagcgccgtccccctgagccaccgatgggtggggggagtggagatggggaagcctctcaaagtcgtgactctgcagaatagtttctgacgctgccctggtgtgcggtgaaagtgagggtgtgtcctggggcgctgggccaggctggaggtgcagggagattcctttgggcttctcagtggtcgccgtggaagggagcggggaagaaggggagggatggagcgacccttcttggggttgccaagcggcgttcgccgcccttcgtcgtccttcgcccttctcttgccccttgcctttgttcgaccgcccctttggtaccagttttagttttgtcccgaggcagattgtaaacctttttgcttcgttttcgtttcatcaaacgttgcattggatttctgtatccgaaacgtggtgtgagctttcagaagtagatgaatacacatatccccggggtgtcatttcttgattggcgtttgacaggggcttgtattgtttgcttgctgacagtccagggtactggccagggatcacttttacttagggaatggaccttgctgctccctagccttattcaaaatggcacctaaaatatgtgtggtgtctccaattggctgtaggtgtgtgattcgttgaccatccctgtttattctgttacagttcctttattgaagattcagcatttacaaagcatgatacgaatcaagagtattgtttgatctcaaggtggattcttgatggtctagaatcttgaatcgaattcttaatgattgcccaacccctttctaaagccataacaacagtagaatggctcttgaaatattctaatacttaaacacaccagtagattcacacacataaaacaaaacccctctgtttcctcaaaatgccagcgctgaccagagtttcttttttaaaatttgagctttatcttaaatatttaatcagatcttttcctcatcccccaaatgaaggaactcaagtagatttctaaggtcccttcctttgacctctccatattgagaatctgtattttgagggtcagcaaaaagctctatattaaaatgaagagaacattttaagtactatttcataagatttagtagaaaattaagtatctagtctgagcgcggtggctcacgcctgtaatcccagctctttgggaggctcgaggcgggcggatcacttgaggtcaggagttcgagaccgcctggccaacatgttgaaaccctgtctctactaaaaatacaaaaaatcagtcgagagtggtggcaggtgccggtaatcccagctactggggaggctgaggcaggagaatcgcttgaacctgtgaagcggaggttgtagtgagccaagatcgcgccattgcacttcagtctgggtgaaaaaagcgaaactgggtctcaagaaaagaaaaaaagaaaattacatatctagattattaaatggttaaggataagtgcagttaaaaattaaagccaggggccatgatgtatgcttttaatcccagctactcgggaagctgagttgggaggatcacttgagccaaggagttagagggtgctgtgatctgtgatcacgccactgcactccagcctgggtgacagagcaagacccccgtctctaaaaataaacacacacctgtgcctcttatagagttagggttttgtacatattgctttgttttaatcttcaacgtaatcctgtgatactggtataattcctcttgtaagcatgagcaaaaagttttaagtaacttgctcatggcaatagcacaataaatttcaggtaggttcctctcctttacttctagtactgttttggtttaatcctgtagcatctttagcttgtactattgtaatatgcttctagtttattttagtgattacagtatgccttcttcaagcctgatttctctgctgctgcaagtgatctaatagtattcaaaccagactaaagtggcctttatgacagcctttcaggaattacacattgcctacaacataaagcctttacgtattttattttatttttttttattttttgagaccaagttttgctcttgttgcccagtctggagtgcaatggcgcgatgttggctcactgcgacctccacctcctggtttcaagcgattctcctgcctcagtctcgcgagtagctggaattacaggcgcctgccaccatgcctagctcatttttgtatttttagtagaaacgaggtttcaccgtattggccaggctggtctcaaacccctgacctcaggtgatccacctgccttggccttccaaagtgctgggattacaggcatgagccaccattcccggcctctttatgtatgatttaggatgacttatcttccataatttgatccttagccagcttccagtttcatctactgctgctttcccttcactctggtaattaattacttacatcttagaacacaccatgctgctttatgctgtggaatgttttccttcttttctgggaattcttctgtcctctcctagtctctgactaacacctaatcttttcttgagattcaaaattgatagtgataactcagaagttaacacttcatccaggaaatctttcctcatttatgaagcattccactttgttgctgtagcctttgtaatacttacatagttaattactctagcctcctcccacccccccattaggctgtaagtttatggagagtcttcccaatgctttgtaccgggcttgtcattaaatgaatactcaacatattaattgaactgatgatagagttgggatttggtgtctgagtgaggttttcaaattctgatttcaggagttggaaagcaattaacagttgtgaggttcttatttttgagaaggtataaaattttcagtggaaacaatatatatccttgggttttaaaaatatatatttcaaaagttagctattttatgaggctgattgaaattttttattgtggtaaaatatatgtaataaagtttaccattttaatgatttttacgtatacagttctatagcattaaatatattcacagtgttttgtaactgtcaccttcattcacatcctcttgcaaacaccattctctttttgtatgtatgaatttgaccactttaggtatctcatataaccagaatcatccatgttgcagcatgtataagagtttctttcctttttaaggttgaataatattccgttgtatgtatataccacattttctttgtccattaattggttgatggacacttgagttgctcccactttttcggctgttgtgaataatgctgctgtaaacatgggtgtacaaatatctgtttgagtccttgctttctgatcttctgggtatacccagaaatgaaattgctggatcatatggtaattctatgtttacttttattccccccagcagtgtacaagtgttccagtttctccacatctttgctaacacttgttattttctgttaaattttaaaaagaatagccattctaatggctgtgaagtgggatttctatatatttttaaatgatttagatatgtctttggattttttcttaattgagcacctcttgttcagaaatgacacttttcaattctcccagatttcttatgactcagaatctgtattccttaagttgttctagatgtgctttattctcccaggaatttttcttcttctcttaaactatctaacctttctctctctctcttcttttccaatgctgtgtgctgatgtgaatgattcttcaattaaacacatgggggctgcgaaacttatcattttgggaaatatttcaatatgatcatattgttggagtaggattcagaagacttgggagtttattaaccaattttatgacattagcaaatcaatctacttctctgaagtctcagtttctttttttttttttgagatggagtctcgcactgtcgcccaggctggagtgcagtggcgtgatcttggctcactgcaaccttcgcctcccgggttcaagcgattctcctgtctcagcctcctgagtagctgggattacaggcgtgcgccaccacacctggctaatttttgtatttttattagagacaggctggtctcgaactcctgacctcatgatccgcccgcctcgacctcccaaagtactgggattacaggcgtgagccaccacgcccagcctgctgaagtctcagtttctttaactatgaaatgagaagttaggtttgatccagtgaaattttattcagcacctactgcatgcatgctcctcttgattaggtaagtgttatgggcatagaaagatgaatgacatgttttgactcccgataactgcctaattggtgatcttctaagggtctgtaaatcttgtcttgttattttttaattaaaaaaattgtgattttgtttgcagttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggtaaaatgtagtccaaattttcatcacattactattattgtatactttttgaaaaataacgccagaaaattatttaattttaatgtagcatttgaagtgctttttttatatgatgagagtatgtcagctatggtgttaaaactgtcttatgcctgttagagtaagggagaaatattgtagctgtttgacaacactatatggtattataaaaacatcgttttaaaactctttttacttttgtttatttttaacttttaggttctgagatacatatgcaggtttgttatataggtaaacttgtgtcacagggtttcaatgtacggatttcatcacccaggtactaagcatagtacccgataggtagtttttttttttttttagatcctcttcctcctcccactctccaccctcaagtaagttccagtgtcttttgttcctgtctatgtgtctatgtgttctcattatttagctcccacttacaaaagagaacatgcagtttgcttttctgttcctgcattagtttactagggaactagcaggtaatgatctccagctccatccatgttgctgtaaaggacatgactttgttctaaaagcatcatttaaattttattttaaaatgtgttgtattaccagatacctctgtgggtcaggagagtggaacactttacagttatctgtattgtgtgaattttttttcctatgaggatgtattaaaagtattagttttattttgtttagactaaaatgaaaccaattaatatttccttagtaattttctgtaatgaggttggaaaattttatctcagtttaaaaatgtggaacaatacagataggtttgttttcttaaaaaaactactacagaatgtaattttgtacatgcatttgtatgttgaaattcaaagcacttcagcatttttaccaaagccctggttctggaaaactgttcattttttttttttggcctttattgcatcctacccattaacgaagagctgtttttctttttctttttttttgagacgagtcttgccctgttgcccatgctggagtgcagtggtgctatcttggctcactgcaacctccgcctcctgggttcaagcgattcttatgcctcagcctcctgagtagctgggattacaggtgtctaccaccatgcccggctaatttttgtatttttagtagagatggggtttcaccatgttggccagtttggtcttgaactcctgacctcaagtgatctgcccaccttggcctcccagagagctgggattacaggcgtgagccactgcacccagcccccttttttctaaacagtaattgttacctaactcctacctggagatgggaggaaaaaatttttgtttaaaaagagaagaaacctaatttttgtctttacttcctttggaatgatctcagtgaccacagttaagaatccatccctgccagcatcattgatgaaggactgcagaaaagacaagaagatatctattattattattattttttttgggattgagtctccctctgtcactcaggggctggagtgcagtggcgccatctcggctaactgcaaccaccgcctcccgggctcaagtgactgtcctgcctcagtctcccgaatagctgggataacaggtcaccaccaccatgcgtgacaaatgtttgtatttttggtagagacagtgtttcaccatgttggcgctggtctcgaactcctgacctcaagtgatatgcctgcctcgggcctcccaaagtgctgggattacaggcgtgagccaccacacccggcctctattatttttaataatataagtatagctttaaaaaatacttccttcaagggttagataaaatgctaaagatctatagttaactttagagataaagacaggctacccccactgggcagtaaaacacacgttggaggaaaatctttgtttacccccgaaggtacagtatgaacctttggcctttagtgaacttcatagcctaatctatgctgaacactgtactagtggtatgctgtcgagaattatagaagtatgcgaattaaatgaaactgtgactgctaatggttaccatttattgagtacttattttatgtcaggcttttattatattttctttaattctcagctgtatgttatccatatcttatatatgaggaaattttataaatgagtgtcaaagaggtttaagtaacatagtaaggcaccaaaagagcatatgatttatacatcaagcagatctgtgttcacttcccagttttgtgtgaccttgggtaagtgatcttagggggcatttatagttatcattcattatgtttagcagtcatagaccttaaattgagaagggcctttaggaagttaccgttccattttaaagcagataaaagagataattagtggcaccaatgaagggtagacaagcatattgggtacccgataccttctataaaagggagtaatatagaatcgactttatcctatgaggggaaaggcctagctgtagttagtaaaaatattactctggactaatcatgcatttaaaaaaaaaattcttgatttttattcaacatattgaaaggaaagtatatacttgctttatagatgcgttatagacattaactcttcattcttgccacgtaagcttgttatttattagctctgctggttccaaacatccaaaaaataggatctatcatttgtcattagtcaagtgttttttagtacttgctaaaagtatttttttatacttatgtgttttttagtatttgatgctgtaaatacaggttactgccttttgtattgtgttaccttatgcagttgaagcaaattatttgaaaccctggctttagtaccacttgtgtttaaaaaaaatttttgtttttttttgagatggagccttgttctgttgcccaggctggagtgcagtggtgagatctcggctcactgtaacctctgcctcctgggttcaagcaattatcttgtctcagcctcccgagtagctggaattacaggtgtgcaccaccatgctcagctactttttgtatttttagtagagatggagtttctttatattggtccggctggtttcgaactcctgaccgcaggtgatttgcctgcctcagcctcccaaagtgctgggattacaggcgtgagccactgtgcctggccaaaaaaaatttttttaattgccataattttaaataaaatctgcatataggataaattttattctgttttgaagtacattaaaataaattgattattagattgtgttcagcttgtacagtggtggttaaatgtcttttgtttgtctttgaaacaggatgatgattggggaaacatcaaaataaaaaatgtaagtattatcttatgaacgtttattataatgcagtaacctcattatgataccaaaatacattccagatgactttttttcatgtgtatatccagttgttccagcactatctgttgaaaatacttaccttttcccattgacttgtgttgggctctttcttgaaaagtagttataggtttgtttttgggtttttgtttcattgatctagtagattaaagttacactagtaccaaatggttttgattactaaagctttataataaaagccttgaaaaaaaaattagctgggtgtggtggtgcacgcctgtaatcctagctactcgggaggctgaggtgggaggctgaggcgggaggcagaggcaggaggcaggagaatcacttgaacctgggaggcggagattgcagtgagccgagatcgtgccactgcactccagcctggcaacagagcgagactccgtctccaaaaaaagagtcttgaaataagatagtatatgttcttatgctctccaactttctcctctttgagattttgtttgagattacattgaatctgtagctcaatttggggagaataaacatcttaacaatattgagtattaaaatccctgaatatgatgtacttccttatttatttaggtctctgtttttctcttagcagagttgtagtttttaaacatagaggttttgcatgagtggttttttttttgagacagggtctcactctcacgtatgccggagcacagtggcatggtcatggctcgctgcagctttaaactcccagcctcaagcagtccttccatctcagccttccaagtagctgggaccacaggcgggtgttaccatgcccagttaattaattaattttaattattttttgtagagatgggggtgtcactatgttgcccaggctggtcttgaactccagggctcaagcgatcctcctgccttggcctcccaaagtgctgggattaacaggtgtgagtcactgtgcccagcccttgcatgacttctcttaaattattggaacttaacatttgttcgctgcttaaaataatattaaaaaatatttccagtgttcatggctagaatgtaaaaatacaattgatttttctctcttttttttttttttttttttgagacagagtctcactcttattgcccaggctagagtgcaatggcgcgatctcggctcgctgcaacctctgcctcccgggttaaagcaattctcttgcctgagctgggattacaggcgcccaccaccacgcccagctaacttttgtatttttagtagagatggggtttctccatgttggtcaggctggtctcgaactcccgacctcaggtgatccgcccaccttggcctcccagagtgctaggattacaggcgtgagccaccgcacccggccaaaatacagttgatttttctaagtttattttcattctttattcttgtaagcaattcacttactaattccagttgtgttttgggcagattccattgggttttctgtgtacataaacgtgttatctgcaaataatgacaattttacttctcccttttcaatattcgtgactttcagatttcttaaactttattgacatataattgataagcaaatgacttcttttttttgagacagagtcttgctttgtcgcccaggctggagtgtggtggtgtgatcttggctcactgcattatttgcctcctgggttcatgtgattctcctgcctcaacctcctgagtagttgggattacaaacgcctaccaccatgcctggctaatttttgtatttttggtagagacagggtttcgcaacgttggccaggctggtctcgaactcctgacctcaagtgatctgcctgccttgatctcccaaagtgctggaattacaggcgtgagccactgtgccaggccttgtcctactttttaataggacttctaatacagtgttaatagaaagtgataagagtggccgggcgcggtggctcacgcctgtaatcccagcactttgggaggccgaggcgggtggatcacgaagtcggagatcgagaccatcctggctaacatggtgaaactccgtctctactaaaaaaaaaatacaaaacaattagccgtgcatggtggcaggtgcctgtagtcccagctactcaggaggctgaggcaggagaatggcatgagcctgggaggcagaggttgcagtgagctgaaattgtgccactgtactctagcctgggcaacagagcgagactccatctcaaaaaaaaaaaagtgataagagtggacatcttggctgggtgtggtggctcacacctgtaatcccagcactttgggaggccaaggatggtggatcacttaaggtcaggagttcgagaccagcctggccaacatggtgaaaccccgtctctattaaaaatacaaaaattagccgagtgtcatggtgcacgccaagagaattgcttgactttgggaggcggaggttgcagtgagctgagatcacaccactgcactccaacctgggcaacagagcaagactctacctcaaaaaaaaaaaaaaaaaaaaaagagtggacatcttgtcttattctagttcactacaacttaaaattatgaaagaccgttacattttgttaagtgttttttctgtttgttaaaatgatggtgtgatttttttttctttttttctgttggtagtgtggttaatctcattgatttttaacttaaaccgtgcatttctgggatgtgcagttctcaaatttcttggttttgtgacccttttgccctcttaaatattatgattgaccccagagtttcatataaaggcacacctcattttattgtgcttcacagataattgtgatttttataagttgaaggtttgtggccaccttgcatcgagcaagtttataggcaccatttttccagcagcctatgttcacttcatgtctctttgtcacattttggtgattcttgcaatatttgaaacattttcattactctcatgtcaagtatgttgatctttgatgttacttttgtaattgttttggggtgtcatgaatcacacctgtaagatggcaaacttaatcgacaaatgtgtcttctgacagcctcaccgacccgcagttccctcctccctcttctcgagcctccctattccctgagacaagacagtattgaaattaggccaattaataaccctacaggctgagcgcggtggctcacacctgtaatcctagcactttgggaggctgaggcgggtggattcctgagttcaggagttcaagatcagcctggccaatatggtgaaaccccatctccactaaataaaaatagaaaaatagccgggcgtagtggcacatgcctgtaatcccagctattcgggaggctgaggcaggagaattgcttgagcctgggagatggaggttgcagtgagctgagatcatgccactgcactccagcctggccaacagagcgagactctgtctcaaaaataaacaaataaataaataaataaataaccctacagtgacctctaagtgttcaagagaaaggaagagtttcatgtcttttactttcaacagaaagctagaaatgattaagcttagtaaagaaggcctgtgtaaagccaagacagtccaaaagctaggcattttgcagcagttaaccaagttgtgaatacaaaggtccagttttcaaaggaaatttataatttaaaagataagttcttgaagtgttactgcaatgaacacacaagtgataaagcaaagcagccttattgctgatatggagtaagtttaagtggtgtggatagaagatcaaactagccacaacattttcttaagtcaaaacctaaccagagcaagaccctaattctctttaattctgtgaaggctgagagaggtgaggaagctacattgtcctcatcagactaacacaggaacagaaaaccgaacaccgcatgttgtcacttgtaagtgggagccgagcaatgagaatacatggacacagggaggagaacagcacacacgggggcctgtcaggcagtgggatgtggggagagcatcaggataaatagctaatgcatgctgggcttaatacctaggtgatgggtctataggtgcagcaaaccaccatgacacaatgtttacctgtgtaacaagcatgcacatcctggacatgtaccctggaacttaaaaaaaaaaaaaaaaatatatatatatatatatatatatatatataaactgaagctagcagaagttggttcacgaggtttaaagaaagaagcaatctctgtaacataaaagtgcaaggtgaaacagtaagtgctgatggagaagctgcagtaagttatccagaagatctagctaagattgttgatgaaggtagctacactatacaacagattttcagtgtggatgaagcagcctgatattggaaaaagatgctgtctaagcctttcatagctagagaggagaagtcagtgcctgggttcaaaggccagactgactgtcttgttagaggctaatgtagctaatgactttaagttgaaaccaatgctcgtttaccattccaaaaaccatggatctcttaagaatgatgctaaatctactctgcctgtgctctgtatatggaacaacaaagcccagatgccagtacgtctgtttatagtatggagtactgaatattttaaggccaccattgagacttcctgctcagaaagattcctttcaaaatattactgcttattgacaatgcatctagtcacttaagagttttgagagacataaacgagatgaatgttgttttcctgtctgctacaacaactattctgcagcccatggatcagtaatttctacttttattatttaagagatacattttgtaaggctaaagtttccctataaagttatttctccatgaatctgggcaaaatcaattaaaaaccttctggaaaggattcacctgaattcttgataccattaggagcattcatgggaggaagttaaaatgaagtcagtatttaccaggagtttgaaagaagttgattctaaccctcatggatgactttggggagttcaaaacttgagttgaggatacaactgcacatgtggtgtaaataggaagaaactagaattagaagtggccaggcatggtggctcactcctataatcccagcactttgggagtctgagacaggaggagagcttcaggctgggagtttgagaccagcctgggcaacacagtgagaccctgtctctacaaaaaataaaattagttgggcatggtggtgtatacctgtagtcctagctactctggagactgaggcagtaggatcgcttaagcctaggagtttgaggttacagtgagctatgattgtgccactgcactccaatctgagtgacagagtgagaccctgtatctaaaaaacgaaaaagaatagaaaaatggagcttgaaattgtgactgaattgccacaatctcatgatacaacttgaacagatgaggaggtaacttatggatgtgcaaagaaagtaatttcttgagatagactctactcctagtgaagaagctgtgaatgttgttgaaatgacaataaaggatttaaaatattacgtaggcttacttgataaagcagcagcaggatttgagaggtttgactccagtttcgaaagaagtcctactgtggataaaatgctattaaacagcaccgcaagctacagagaactctttcatgaaaggaagtcagtcagcgtggcaggtttcattgttgtctcattttaagcaattacccagccttcaggaaccagtgccgtgatcagtcagtagtcatcaacttggaaacaagaccccccacctgcaagaagatcattaactgaaggcttagatgattgtcagcttttttttttaagcaataaattattttaaaattaaggtatgtgcattcctttttagacataatgctgttgcatacttcacagactgatataaacatgatgtttgtatgcactgggggaaaatttttgtgtgacttgctttattgcgatatttgctttctcatgctctggaacccaaactgtaatatcttcaaggtatccctgtgttttaatctatgtaatactcttttgttggatagaagataattttatctaagtcagttgatcacattttttagtgatttgtactatgttgtaagaaatcttcgcctgtgccaagtttacaagattttttttttctgttttcttgtaaagcttgataagttttagctgttacatttagatatattgtctgtctttttttttttttttctttgagacggagtctcaccctgttgcccaggctggagtgcagtggcacgatctcggctcactgcaagctccacctcctggttcacgccattctcctgcctcagcctcccgagtagctgggactacaggtgcctgccaccacacccggctattttttttgtattttttttagtagagacggggtttcaccatgttagccaggatggtctctatctcctgacctcgtgatcagcccgccttggcctcccaaagtgctgggattacaggcttgagccaccatgcccggcctatattgtctgtttttttgagacggagttccgttcttgttgcccaggctggagtgcaatggcgtgatctcagctcaccgcaacctccgtctcccaggttcaagagattctcctgcctcagcctcctgagtagctgggattaaaggcatgcaccaccacacccagctaattgtttgtattttttttagtatgttgttggtcagactggtctccatgttggtcaggctggtcttgaactcctgacctcaggtgatccgcccacctcggcctcccaaagtgctgggattacaggtgtgagccaccgcacccggtctattatctgttttgagtaaattcttgtgtttgctgttaagcaatggttgaggttatttttttcacatgagtatttagtgagcaacatttgttgaaaagactattcttttccattcttcctcagtgcctttgttgaaaatcagttgaccataaacataagggtttatttctggattctgttttcttccattgatttttatatgtacctttgtaccagtacccattccctgctgttttgattcttcaggccttgaaatcaggtcgtctaagtcttccagttgtttttcttttttaaagttgcgttggctattctgggaactttgtacatctattgcacatttttagattctgcttgtcattttctccataagagtctgctgggattttgattggaattgcattgaatctgtatgtcagtctgggacatctcaatattgagtcttctaacttacaaacatggtaaacctttcctttatttaaatgttcaatgttgggacttacacatattttgttccacatattgttaagtatttcacgtttttctttctttttttttttttttttgagacagtcttgctctgacgcccaggctggagtgcagtggcgtgatctcagctcactgcagactccgcctcctggcttcaagtgattctccttcctcagcctcctgagtaactgggattataggcacttgccaccatgtctgactaatttttgtatttttagtagagacggggtgtcaccatgttggtcaggctggtctcaaactcctgacttagagtgatccacctgccttggcctccccaagtgctgggattataggtgtaagccactgcacccggcttatttcatggtttttaatgttgtcgtaagtggtacttttctttctttttttttttttttttaaagacgaggtcttgctttgtcggctggagtgcagtggcacaatcatagctcgctgcagccttgaattctggggctcaaggggttctcccacctcaccctcctgagtagttgggactataggcatgcaccattgtgcttggctaattttttgtttttgtttttgagacagagtcttgctctgttgcttgcctaggctggagtgcagtgacgtgatcatggctcactgtagtttctgcctcccaggttcaagcagttctcgtgcctcagcctcccgagtagctgggactacaggaatgtgccaccacgccggactaatttttgtgtttttagtagagatggggttttgccatgttggccaggctgttctcgaactggtctcaagcaatccttctgccttgagctcccaaagtgctgggattacaagcgtgagccactgcacccagctgtggtgtttttgaaatgtcattttccaattgcttgctagtatataaaaataaagttaatttttataattgactttgtatcctgtgactttatttcatatattaatttcttaggatattgttaggtatacatgtcatctgcaaataaggacagttttatttcttcctttttaatctttgtgcattttgtttctctttttttctttattgcaatgcttaagactttaaacaatgctgagtagaagtggttgatagtggacatcattgcctttttcctgaccttaggggaaaagcctccagtcatggctggtggtagtttatagatgttcatcatcaggttcaggaactctttctagtttgctgagaggttttgtcacgaatggaagttgaattttgtcattttgttaaatgccttttctatatcatttcttcctctcattttatccattaaactacacagacttttgagtattaaacagaacttatattcttgggataaaccccacttggacattatatattgctagattctatttgcttatcttttgttaaggttttttgtgtctcttttcataagagataatggtttgtagttttcttgtattcttttttatctggttttgctatcagtgtaatgttagtcttatacagtgagttaggaagcatcccctcttttctgagtttgtattaatattttttcttccttttttatttctgctcccactccactgggatattttttctttaaatgttgcctaaaattctctagtgaagcctagttcactagacttcatgtgggtttggagttttctttgtaggaagactttaagaatttagtgtctttaataaatgtaggactatttagatattatgttttctttcctatcagtttgataatcagtatttcttaaggaattggttcatttaagttgctgaattgattgtcatattctactgttattaccctttaactctagaatgtgtagtgctgctttttcgttttcctctctagtattggcaaattatgatttgtctgtttcctctatcatcaagccagagttttgtcagtttcattgattgtgtccccccaaaaaaaaaacatttggcctgttcatttattacttcgtttattttttctctttgctttctttctttctacttcggttttaaattttttaaaattttgaaaatttttatataatcatattttgttgaatgaagtgctgaaacccaggcaaatggtggtgacttttttggtttgttttagagatggggtcttgctatgttgctgaggctgaccttgagcacctaggctcaagcagtactcccaccttagccttccgactaccttggactacaggtgtgtgccaccacacatggcttggttttaatttttactttttctagcttaaggtagaagcttacctagttcattaattttaagcctttttttaaatctcttttgctcatttttgtagtatgtatttgctttttcttatagatttgcttttttgagtgcttagtatatatggtatagttttgcccctagtttattgttttcaaatgttttatagacatttttaagatttgtgtagctagttacatcaattgttaatatttatgtcagttttagaaaatcttccaacaatgcatgagttttttgattcacttgcattcttttatgaatattaatttttttacatttaaatctttaattaattgttgttgtggtatggtatgaagtagagagctgatagtatgttttttctaaagtatacagtttttctcaatatttttcattgtataatcccttttcctaataattttttaagggcattgttttagtctctattctttttcagaaatttcttagctattatcctgggtataaatttgctgcatgaatgaatcattttgcaaggttttgtaaaggaatttcattaaatttatataactataattgcatctttatagtaatttttcaagtccagagcttgtcatgtcttccagtttatttaggtgctttttttaaaaatatccttaagtaaagctttattctctcattaaagtattacatttttcttgttatgcttattcttagatatatgttggcatttcttctattgtgttttccaactggttattgctagtgtattctttaaatagttggctcttgagacagttgtctttggaaaaagattcttggcctggtggggtggcttatacttgcagtcccagcactttgggaggctgagatggggggatcacttgaggccagaagtgtgaggctacagtgacctataattgtgccactgcactcctgcctgggtgacagagtgagtccctgtctctaaaaaaaaaaaaaaaaaaaaaattctgtagtgatggcttagtactgctttactgctttgcaatgatcttataaaatgtctatgtagaaataaaaggtgatagaataaaggtcattaaatttaattgtaggtattcttaactgaactaatttcctaattttaatcatcatctggatatttttagtcttctggctatcatttttccctccctgtttttttttttttttaaatctccacttctggtcctaccttttactttgtctcatgtgttcatgccttccaattaagatactgagtaagagagtaagatgttattcatattttaagattatgagctttacaatgacagtgtcttccttgtctttctattgattgtatggagtgtttgcatatgtattaaataaaagtatttacttaggttaatgtgtagaattatataattggatattttgaacaaatttactctgtatttggtttgatattttttagtaatagagaatttaatgctctaaaaatatttgtatttaaatgtaaacaatcactacagttacacaatagacattcacagaaataattttattagtgtttgtttgtttgtttgtttgttatattttttgagacggggtctccctctgtcgcgcaggctggaatgcaagtggtgtgatcacagctcaccacagcctcaacctcccaggctccagtgatcctcccattttagcccccaagtagctgggactacaggcatgcacccctatgcccagctaatattggtattttttgtagagatgggatttcgccatgttgcccaggctagtcttgaactggactccaaccatccactagccttggcctcccaaagtgctaggattacagcatgagccaccatgcctggtctgaattttattagttgtaagtttgttatggagagagataatgccactaaatgttaatgatcatttgaggaattccctctgcttcaatattgtaaacattattaggtgtttttatggcaatacttattttttccttaagctttattcaggtacaatttatatagagtaaaattcacctgtgtttgatgtacagtttgatgactttgggcgattctatattgtcatgtaaccactaccacaatcacgatttagaagtttcatcacgaaaaagtttctttgtacacctttgccttggcctcaaacagccaccccagtgctttttacttgttttaaacaatgcagtgatttttagtagtgtatttacagagttgtgcagccttcaccacagtctaattttagagcatttccattaccccagaaagaaacttgtaccatttaaggtcactccctctccccatctccagtcctaggcagcaactaatctactttctgcagatttactttttttggcaaatagaattatgttatatgtgttcttttgttcctggcttcttttggtttgacataaacattaccaacttttaaggattttcatgaaattactttttttaaaaacagggaatgactctactaatgatggggtcagcagatgctcttccagaagaaccctcagccaaaactgtcttcgtagaagacatgacagaagaacagttagcatctgctgtaagacacaccagattttatgtgtttgatcactactttttgaaggaccattattaaggtgtctttcagaaagtagcatctgaatgtcttgaagacttaatcattaataccaagatagatatttttagcagtaaataagagttttattatttttgattagcttaagggagtccttctgtagttaaataaggcacagctaggggtttttttttgtattgtacaccttactactggttttcagacttccaagtgaatttacttaggcttaacttacatatatttagctaatatctgtaataaatatgttcctggcagatagtactatataagtatttactattactattttatgagaaaacagggtcaaagagtagtttaaatgttgggatatttaaatttttaaaatccttcatgtggaaaatacatacattttatcctgaatttaaatgcaaaatcagtttagaaactggtcaacacgtgtcaattttttttttaacacctagcatttatttagtgccattcattcattttcatggtttttttttttgctttttttttttttttccttgagatggggtcttgctctgtcaccccggctggagtgcagtggtatgatcatagctcactgtaacctcaacttcctgggttcaagtgatcctcccacctcaggctcctgagtagcgaaaattgtaggcgtgcaccatcatgcccagcaaataaaaaaaaaaatttttttttttttttgtagagatggggtcttgccgtgttgcctaggctgatcttgaacttctgacctcaagcagtccttccacctcagccttccaaagtgctgggattacaggtgtgagccactgtgcccaacctgttattttgctttttgttttgaagtgtttctttgcatattttgcctattctcttctcttgataaacctgcaaaaaaggcaagactagtatgattattctcttattatatttaagaaggaaactaaaacataatatgatggccagcatgatccaagtaaacttttttttgggggaaataaaactgtttctttagcgtgaaggcagaatataaattggtagaagctagtaaatggtacttgattcaaaatgagaattttagtgatttatatatgccatgtcattttgtaaaaatggtttaatgatttaatccttttttttttttttttccaactagatggagttaccatgtggattgacaaaccttggtaacacttgttacatgaatgccacagttcagtgtattcgttctgtgcctgaactcaaagatgcccttaaaaggtaagactgcagtcttttttgggtaagggatgttcacatttggatgagtagtattgttttgttttgctttctttagcatcttaattgagatataattaatttattatacaattcagcattttaaagtgtttaatgctttttatagtatttacaagtttgtgcaaccatcaccaccatcgattttaggacattttccgccccctccaaaagcagtgtcgtactcactggcagtcactcctttaaccccttcacccacctctagccctagccaaccgttcatctactttctgtcatagatttgctcattctgggcatttcatgtaaattgaatcgtataatatgtggcctttttgcggctaacttctttcatttggcatgttcccatggttcattcaggttacagcacacgtaacacctcattcctattttatggctgaatagtatttcatggttcactcacgttacagcacacgtaacacctcattcctattttatggctgaatagtatttcatggttcattcacgttacagcacacgtaacacctcattcctattttatggctgaatagtatttcatggttcactcacgttacagcacacgtaacacctcattcctattttatggctgaatagtatttcatggttcattcatgttacagcacacgtaacacctcattcctattttatggctgaatagtatttcatggttcattcatgttacagcacacgtaacacctcattcctattttatggctgaatagtatttcattttatggatatatcacattttatttatccattcattttgttgatggaaatttgaattgtttctcctttttggctgttatgagtaatgctgcagtgaacattcatgttttttgtgtagatgaacgttttcatatagtaactctatgtttaatgttttgaggaactgccacaatgattttccaaagtgacggtaccattttacattctcaccagcaatgtgagaaaattgccaatattgtctgtctttgattaagccatctagcgctatgaagtgtggtatctcattgtggttgtcatgcacattttttttagtggctaatgatgttgggcatcttttcatgtgcttattggccatttgtatatcttctttggagaaatgtctgtttaaatcttttgcctgtgttttaattgggttatttgtctgtttaaaaattcaattgtgtttttacatatatacaagttccttacccaatggataatttgcaaatcttttcttctatactataagctgtcattttactttcttttttaaaatttatttttttcctaagtctgttgtatgcagtctccttttacttttcttgatggtacgtttgtaatgcaaatgttttttaattttgatgtagtttaatcttaattttaattttttcttttatcacatatgcttttggtttcatatgtaaaagccattgtctaattctaggttacaaagacttacttctttgttgtttttcaagagttaatatacttttagctcttctattcaggcctgtggttaatttttatgtatggtgggagggagggaggtatttgcctattattttgcatgtgtatatccagttcttccagtatcatttgttgaaggctattgtttccccactgaattgtcttagcaccttttttgaaagtcagttgaccttaatgtataggttcatttctggaccctggattcttttccatttatatatatgtctatccttatgtcagtcagtactggtttcaaaaaagaaagaacattttgtttttataccatcgtatgaaaggaaaagagtaaagaattaattacaaatgttttgagaacctgtaaaatggtctacaaataagggccctttcttccggtgagtataagtgtaacttaaaaaatatgtaacttaattctgactaaatttatacaactgtcttgatacataaattgtcagttctttatgatagaattctgaactacaatttggattctagacagctttatgaatattgatttttgttttttcccctcagtctattgtgaaatgttgtgatagaactgagcagaagagaagggagagaaggagtgtgcaaaaatctgaaagagtgactttaaaggttttctacatttctctgaagcgaatagttgtcaggtatttatgagaaattgcatagattgcagctgatatattatcagtgaacaagacacagtatctgtcttcaaggcacctacagtctaatagagaaagactatcaagtaaacaggtactgtttcagaactgctttgatgggaaatgtaggctgctatgagaacatctaagggagttcatcaggggtatctgaggatagtttgggaagacttcttagagtaactggtatttaaacagttaggtgttatcccagcctggatgagaggttagggaagtgtgagagtggactggaggaaagagtttttaagcaacagtctggaggcaggagactgcaacatactcagtgcaactgcctggagaaggatggatgtagaaacggtgatagatgggagattagcaggggccagccagaaatcttgaagtcgtttttaagaagtgtggacttcgtgttgtgggcgaagagaaaccattggaagattttaagcagagtactgacattcaaattatcctctgaattctaggtagctaagattattattttattcttcaacagtttttattttaattttgcttaaaaaattgcctggtgaatcttactgtgtcttttatatatatcccaaaatattgctttattttaccctttcctcttatccttggatgataatattgcttggagcaagagtctaggtcaaagccatttttcctcagtgattggtagttatttgtccactatttttgtgtgtccatgcttactgatgagaggtctgatatcagtcttgatttttattcttttctgttagtagcttttagggttttctcttttttttttttctttcccccagttttccaagaatgtgagactgtgggttttatttatcttataaaagtactcagtgagcacttttagtctgaggactcttgtcgcaaactctaggacatttcttggtcattatttctttaggtactgcttctcctccacctggtttcttatacatattaaaatttctagatctgttttttagtcttctaactttcctccgtgttttaaatttttataatttttatgtgatgtgctctaggaaaatgcctcagttctgtcttacattttactgattcatacgtctactttgtttcactgcttacttatcatgaccttctgttcttttttataactccttattcttaatttttggatctaaatcctgcttttatttttctgaggctctgaagtatttttatttaaaggttttttttttttttccttgttgtttggccttttaactctgttctttttggatgtaagggttgttcttccctcatttgtttaaaggttgtgtgctcatatcatgcaaccatattctcttccttatgtcccagttgcaaattatctgaataggtagtttgctggggtagctttctggctagcacccttgggagtggctgatggagatagccttggctcacttccaagatttcctctttactgttttcttcttggatgccttttagcctctgttcctgagagagtgctcttttatgttttggaaagagttctgtgtaagcaggggagatttcatcctatgtggttctattttcctgaaaccaaaagaagtattttttgtttttcctttttttaaaaaaataaaagtgaaagttacttttttcgctttttggtttttatttttagtattttttcttttttttgtacagcaacctctgatgccaaacaaaagaagtagtttttgaattctaaattttctcaagagagtgcacttactaacgtaattgatacaagatgtcatggatggtggtatgtctttggaaaaatggcactaactgataaaacaagaatgaaagaacagaaaaacattccacgagaggtgttttacagctggagatgaggaagaccatcctcacaaatacttagcagaacttgtctttggcaggttctatagagtgggaggtatgggtcccgagtgtgatggctcacgcctgtaatcccagtactttgggaggccgaggcaggtatctcacttgagcttaggaatttgagactagcctcggcaacgtggcaaaaccccacctctacaaaacagacaaacaaacaaaaaaccaaaaattagccaggcatggtggtgtgtgcctgtagtcccagctactcagaggctgaggtgggagattgcttgagcctgggaggtcgagtctgcagtgagccatcagtgtgccactgcactccaggctgggtaatagagtgaggccctgtctcaaaaaataaaataaaataaaaagagagtgggatgtataatgatggagggtagaaggaaagtgtgttcaagagaaatagactggattagcttaagaggcagtaaggatcaagaactatagccacaggtgaaaataaggtttgaaatggcttgcttaatgccgcccaacagtggaatcccatcatactcctggagttagattctcaatttagaacctagagtgaaaactatatgttataaaaaaatcatcctaaaattctataaattactcctcaaaagacagtatcacatggccgtatctgttgtattggagactggcaagccccagctctcaatatacacagcgttaacagttactaggttgctgattttctttcattttttttttcttattttttatttatttattttcgagacagagtctcactccctcacccaggctgcagtgcagtggtgcgatctcagctcactgcagcctctgcctcccggcttgagcaattcttctgtctcagcctcccaagtagctggaattacaggtgtgtgccaccatgcctgactaatttttgtatttttagtagagacgggttttgctatattgtcaaggctggtttcaaaatcctcacaagtcatctgcccgcctcagcctcccaaagtgctgggattacaggtgtgagccactgtgcctggctgaaaatatttgtctgttaacactagcgtctcattcagttcagtgagatgctcatattatgagaggcatgcaagaactgagacactcggagagaacagaaaagccccatatctcatctcacagctgtctaggggatatgttcattgagtggaattgcatgtgggattgcttacactacttaaattattttcttttttttagctttttgagggcatgtcttcatttaaaatttaaaaaaattttaaattattttttattttttgagacaggccctcgctctgttgcccaggctctggagtggcacgatcacagatcactgcagccttgacctcttgggctcaaggatcctcctgacttggcttcccgagcagctgggacctcaggcatgcaccactatgcccagctgattttttttttttttttttttaagtagagacaagagatggctatgttgctcaggctggtttcaaactcctggcctcaatcaatcctcccagctcagtctgccaaaatactgggattacaggtgtgagccaccacatctggcacacatatcttcattctaagtaacagatttcaacttgttcttgacaaaaaaattttaaataacagaaaagtctacatatttgatattcactttttctcagccatcttctcggcccttatgtcaggatatgatgaaaatgcatcatacatttaattcatacagattgaagatgtgccctgggctggatgtgatggctcatgcctgtgatcccagtgctttgggaggctgaatctatagcttgaggccagaagtttaagaccagcctgggcaacatagtgagacccgcatctctgcaataaaaaagaaatagctgagtgtggtggtgtgcacctgtagttccagctactcatgaggctgagctgggaggaatgcttgagctcaggagtttgcaactgcagtgagctgtgatgatgccactgcactccagcctgggcaatgcaatgagaccctgcctcttaaaaaaagagatgggccaggagcagtggctcatgcttgtaatcccagcactttgggaggctgaggcgggcagatcaccgaaggtcaggagttcaagaccagcttggctaacatggtgaaaccccgtctctattaaaaatacaaaaattagccaggtttggtggcaggcgcctataatcccagctactcgggaggctgaggcaggtgggtcgcttgaacccgggagcagaggctgcagtgagccgagattgcaccactgcactccagcctgggtgacagagggagactgtgtctcaaaaaaaaaagagaaagggatgaagatttgcgttatatttgggttttttctttaaacatatgtgtagcagtgtatgtgtttttttataaccaattcaaacagtcttaaatttgtgctcatgtctttgtttttatgcttacatattaacaattctgcagtacatcttgatgcataggattctttggatcaatttctggaagtggagttagtgggttaataaattagagtggatagtttgacctttcagatattggcagttgttatcccaaaaggtagaaaaatatgaatgctacattctgtacatattcatcaatgtaaaatattataatgataaatattttttgactactggtaagattgaactactgtttactcgtgagtttattggtgacttacatttctaaggtaaaaatctaggtttctcttttttctcccatcaccatttattgtatattgatacacattgatcttttatcatatgtattattattaaatatttttgagacctgttcctagattttctaactgggtttatttattgaggtctgattttcgatatgtgtttgtattatgccattttaaccatctggtgtgtagtaatgcatacttcttactttcagtgtattactggatagtttgatccatattttacatatctttgaacttcatagtcatgttcaatacgcctttctccctctaaatggatatatagtgggagtgtcagcctttgggattttgaccataatggctttaagtttgggataaattgacatttttgcaatatttagcttccccatccaggaatataggctgtctccccattgtttcaggtcttatttgactttcagtaagatggatttttttcacgtgttttatttccaactgttttgaatttttgtattttgtaatgttagatgaattttcccttgatcattttgttattggccctgctagctgatgggaagaaatcaggagtactaatttcaaatatcagatttccatggttccaagatatactttcccctaatattgaaatagtccttatattctatgaaaattttaatgtagtttttatttaccttgaaaacacatttatttaccctgaaaacacattttagttatgatgatatttatgattatgatttatgatatatttatgaggaaataaggcatattttctattagtatttggattttctaaatagataatcaaatccattactcaggttatttttgtctgtttcaggtagtttacttcatgtttctttcgtgcttcactggctagaacttttaacacaatgttaaatagtagatggttgtggaattctctcttgtttttgattttaataggactgttgtattttagggttaaatattgatcttgggtttggtggaaatgttctttttttcttttttctttttttctccttgtcttcttcccctcaggtttggtggaaatattcttaagaatgttaagaaagtatccctccatttgtttactggaggttttttaaaaataagaaatacatgttaaaattatcaaatgttgtttgttgacctagtactaagatttttctcactggatctatttgtgatacattatgttaatagttagcctaatagtagactatattcctgatacattcgtattctttcaatatatagcgctgaatttaatttgctggaacattttaaaaggattttttggggtcatttgttagtaagactgatttatagcattctgtctccctctggcttttttttttttttttttcctttgtgagggtttggtgttacagttatgctagctctatgtctatcttttcctggaacttttattttctttcatgtttttataggactgatctgttgttgaaagccttgcccatgaaattgtctgcactcagcttttttggggtattttattttattttattttattttgagacagagtctcgctgtgttgcccaggctggagtgcagtggcatgatctcggctcactgcaacctccgcctcctgggttcgagcgattctcctgcctcagcctcccaagtagctgggattacaggcacccgccactatgcccagctaattttttgtatttttagtagagacgtggtttcaccatgttggccaggatggtcttgaactcctgacctcaggtgatcccccggctttggcctcccaaagtgctgggattacaggcgtgagccaccgtgcttggcctttggggtattttaaatgtacttattctcttctaaagtcagttttggtaatttatattttcctacaaaattgtcctgtctttaaattatttcagcttaagagttattctactattggacctgtatggttttttttttgtatttttatttcttatttgttatatttgtgttttcctcccttgattttcttgctagagatttgtattttagttttcaaagaattggctattagatttgttcattcaattttttgagttgtctgattcatcctacttttgtttgtattaattttttcttatttctgtttaccttaggcttgttttattgtctattttctaacttaaaagtttcatatgtggattgtttacttacccttgtgtagtaatgaaagcatttagttctgagattttgcttgttctctatttgttagatgaggctgttcaaatgttgacaaaagccactagaaagtctcttatcttttccttttagctcagttttgtttgttttttctttgttttttttttgagaaggagtctcactctgcctccagactggagtgcagtggcacaatctcggctcactgcagcctccgcctcctgggttcaagtgattctcctaccacagcctcctgagtagctgggactacaggcgcgtgtcacaacgcccagctagtttttgtatttttattagagacagggtttcatcatgttggccaggatggtctcgatctcttgacctcgtgatccacctgcctcggcctcccaagtgctgggattacaggcaagagccaccatgcctggcgcgtttatttttgattatggaagtataacatgccagagtatacaaattataagtgtacaactcaatgaattgtcccagggtgaacacatccatatacccaaaataaaggcagaacccttctagcactctaaaaatcccctcacagatcttaatcactaacaccgtttatgtttcccaaattggaaatactatcctgacttctaatctcatagatcaattttaccagttttgaactctatgaacagaaatgtacaaattgggcccatttgtctggctgatgactgggtaatgggtctggctcatgatgtttagtgtatccatgttctgtgtattggtggttcgtttatattcatgctatatagtatagtattccgttgtgtcctgtactaccaagttattatccattcttctgttgatgaatatttggtttatgttcagtttttggtgattatgaaaaaatatactctgaatattctagtacatttttgggcacatgcatttgtttctgttgggtatatatgagtatgtatgcatatgcacaaaatatatatgagtgaaactgctgggtcataaaaggatttatatattcagttttagtatgttttgccaaccagtttcaaaaacggaggtaccaattcatattttcattagcattatatgtgctttccatctgttccacatccacccccaagagtttaagccaagttatttagccagtggatttagaaacacatatatgaaagcatatgttataaatgtactttatttcactatgggtaaggattgtggcctacataacttttggtttttggaaatttgagtttgtctttttgatctgatgtatgattgaatatttcatagggactagaaaagtcaaaatgtcctctctttgtaggtgtcaaagtataatagacattaggttaattttattatgttctgattttctatatcattactttttatttattgacttgacagagataaggaaagattctcagtacttttgactgtaaaacctctcagtatttctgtcagtttccttttattttctaagtttttctttataaacttcagtgttaatgttatttggcttaatggatggttttacatgaattaggaattacattttattgctctaatatgggaatttttttttggatattaaattacatatgaccttccttagttacaaaaaaaaggttgataattcattagtatatctttgccataaatgtagaaatagttacatattcatgttaccctataacaagaagtaaaattcagtaacagcagcgattatatagctaattacatacccaagtgatgttcagggtatgtctgctatattagtacttaattttaatttcaaaaatgccttttaagaagttgctaaaatgtcttaacagggaaatgtaatgattttcaggtttttaaaaatgaacacacataattcaggcattattgtgaattattgtgtattgaaaaattaagaaaattcgttgagtcacatcagtttccgaaagatgcaaacaaatgaaaaagggaaaaacaaaatccttcaattgagtacaatttaacacaatactctctgtgatttctttcatactacttaacataagcatagaggttttgctttttaaattgagatataattcacatctagtgaaatgcatatatcttaagtgtttggtttgatcagttttgacaaatgcaaattctctgtaatccatttgcctatcaaagtatagaacatttctatcatctcagaaaatttcttgggcatgccttttctcagttaatccttatcctctccacccccttccagcaactactgatttcatattagtttgcacattctgaaacgtaaaataaacggaatcctacaggtcatgcttttcttttgttctggcttgtttcactcagtatctagcttggagatccattcatattattactgactagatcagtaattctgattgctccacaatcttgccgatattgggtgatactagttttttttaaattttgattttagtcactctaatgggtgtgtagtatgtacacatagtttaatcatagtgtatatgcagtctccctctcacttcagtgtttgatattaactgaatgataatttctgagcttttgtaataagacattgtgtgagtaatgactatggtttgaatagtcatttgaaaaggaatttgcatggccagtttgttgtactgttgtaaattaagtgaggatcataaagctgaaagtgaatttagaaatcatttaatagaagcttctcagtttacagatgagcaaactgacctacaaccttaagtgacctatttaatgatacacagcaagctaatgctgaatgtaggtgtatgatttttgattgaatgtttttgatctaatgcttatttcttccaagttatttcagagattgtgttattttattttctttgtaattaatgaatagtgttgtttcacaatactttcagaaaatgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggaggtagaggttgcagtgagtcaagatcatgccattgcactccaacctgggcgacaagagcaaaactctgtctcagaaaataaaaaataaaataaaatgttcgttttatatgagtttgacaaagggaaagagcttaaagtaggctccatctaaattcccttttcagcattcctttttttctccatatttctggtcatgcaagaccagaagagaagaaaaggaaaggtgggaacaactctgagaaacttgcagttgagggtgtcataagaactccttttaactggtttcttcccatttgagtgttagaatgaattgaattctattgtttaactcggctttaatgttcctaggtatgcaggtgccttgagagcttcaggggaaatggcttcagcgcagtatattactgcaggtttgtatactaaatatactactttttgataggagtaagacattctatttttcgctcacaatcctttgcagtttacagaatgtcttttgtaaaacatcacctcattaagcctggagtgtacattatacttaagttaaacaacttggtacttattttatcgtccagattataaatcaatgatgtctgtcgtttgtgaaaaataatctttggatttttttggattaaattataattttggcttcaggtttgatttgtataatacatatctttggggttgactctggggatagccagcgacgggttttatcataatccatgtatcattataaaagagggtcttagtgaatattggtgtaaagaagtgatgtgtgtgaggagaaatagtaatcttaaaggatagaaataactggtttcttcattgcataagagaatataacccccacctaattttggacattttaatactgttaaatctttgggttaggtcaatagggttttacagccatgcctttttttttactctctctctaacagctttattgatatagtgtacatatcataaaatctgcccatttaaagtgtataattcattgttttttagtttatccacagagttgtgcaaatattactaaaatgttaattttagaacattatcattccaaaaagcaacttcataacatctagcagtcacctcctttcccatttctagccctacccatttatctatgtgttatttctctctagatttgcctactctggacttttactctaaatggaattaaataatatgtagtctcttgtgactggtgtctttcacttagtataatgttttcaggattcatccacattatggcatgtatcagtacttcattcttttttattgctaaataagagtgccttgtatggacaagccacatatcatttatccattcatcgttggtggatatttgggttgtttctgcttttcgactattacaaatactcctgacagtcgtgtacaagtcttggtgtggacaaatgctttcatttctctttggtatgcatctaggagtggagttaattactgggtcatatgattactatatttaaccttttgaggaactgccagaattttccaaaggagtcccaccgttttacatttcccccagaagggtatgagggttctgatttctctgtctccttaccagtacttagtattgtatgtctttttgactatagccatccaagaggtatgaagtgttatctcattgttgtcaaccattgatttttgatattataaacaggtttcttttgtgtcatttgcagttagagagattttactctaactttttttcctaaagtagacttacttgttgaaatgaagtttttagtgagaaagtgtgatcatttatatctacttcatttgacagctcatgtatcttagaataacttagaatttcagcagcttctgcagcatcatatatgcggctaatagtattgatgcgatgaaaaatactgttctttacatttttgcttcttgattttttaactttttgttttgaaatacatttaaatttacagaaaagttgtaagaattcaccagttactaacttttagtcgcatttggtttctcatttttccgttatgcatgtaatttttttctgaaccattttagaataaggcgccagacatcctgaatatttcagtatgtatttcctaacaataaggacattcataaccacaagacaattcttaattttcagaatctgggctgggtgcggtggctcatgcttgtaatcccagcattttgggaggctgaggcgggcagatcacttaaggccaggggtttgagaccagcctggccaacatggcgaaaccccgtctctactaaaaatgcaaaaattagccgggtgtgttggtgcatgtctgtaatcccagctactcgggaggctgaggcacgagaatcgcttgaacctgggaggcagaggttacagtgagctgagattgtgtcagtgtactccagcctgggcaacagactgagacactgtctcaaaaaacaaacttttttttagaatttgggagtttcacacagtaccctaaaatacagtctttattcagattttgccaactgtcctagtattgtccattaaaaaagttttttttttttccttcttcaggattcagtttaagatcccacattgcatttagttgttatatcttattagtctcttttaatctatatttcttcttgacctttttctttcaaactaatgaaatacttttgagatgctctgttgatggtatatactagatcttaaatcatctgtttttttgagtagtgtataaaatattgttaaaatgtaggcttttatttaaaaaaataattagcttggtagtgatgcccaaatttcagccttccctccaaaaatattttttaaacattgtgttcagttttgttattcaggaacattttattgagcccctgctttgtgctaagatgctgtatttggtgggttcagtctgtataatgatgataggtgacatttcacatcttgggtattaataaaacatacaagttgagataagctagaggaagagttttgctgtacatgaaggagggcaaggtatgatcactaggaagtccgcagaggagaaatggttcgaaatccaagagaacagactagtccatgactgtgagattcatgctgctgagaggggtaagtggaaagaaggttttctgaagaaggtaaattcttagtagttttggttcttagctgtccagtagagtcagctgtttaaggacccagatttaaatctccaggagttgagtagatgagaaccaactataggtttaaagggaggtaagttgggagaggtgacccgctatcctgatcttggcagagtagcagaacaattacattatgcctgtttgtccctaaacagaggttatgtgttctttgtactgaattaaaacaccctgctttgtttgggaagacaaaggctggcaagaagaaagagagagggagggctcagaagttgtttacagctagtgattgctttgtaaggtcttctggtgagttaagatttaaaaaggatttttttttttcttattgagagtccaacaattgtcaaagagtagatacacttaaaaatgtttaagcagctgggtgtggtggctcacacctgtaatcccagcactttgggaggccgaggctggcggatcacaaggtcaggagttcgagaccagcctggccaacatggtgaaaccctgtctctactaaaaaaaatgcaaaaattagccaggcatggtggcatgctcctgtaatcccagctactcgggaggcccttctgtgttcaagcagttctcctgcctcagcctcccgaatagctggggttacaggctgaagtgagcggatcatgaggtcaggagttggagaccagagcctggccagcatggtgaaaccccatctctactaaaaaaaaaaatacaaaaaattagccgggaatggtggcgtgtgcctgtaatcccagctactctggaggctgaggcaggagaattgcttgaacccagaaggcggaggttgcggtgagccgagatcgcgccactgcactccagcctgggcaacggaccaagactccatctcaaaaaaaaaaaaaattaagtaagtttttgtttgtattaattaaaattaatttacagtcgcgtgtattaaatatgtgactgttttactaaggcaatgtttgctttgtctttaagcccttagagatttgtttgattccatggataaaacttcttccagtattccacctattattctactgcagtttttgcacatggctttcccacagtttgccgagaaaggtgaacaaggacagtatcttcaacaggtaattagggcaaggtatttttcattctgtaaatgtaaaacttaggtttcctacatttaccgtacttactggaacatagttcgaaatataaacatcagtcttctctagttcatgccacggctgtctcttgcctggagccgcacagtagtcttaactgatatctggcttctgcctttgcccctttgcagtttctctacacagcccgcaatgtcctttttaaaatgacgataggattatgttggccccttgttcagtactccctagtgattttctaccgcagtcctaaatcctctagcccctggctttctctctgagttcatcactaccactctgtcccttgcttgcctctctccagctgcacaggcttccttaaacctttcaagtgccctcttcctgcagggcctttgctcttgttctttggctgtcagataagtgcaagaccagctccctcacctccttcaggtctcatggctccaaggccaaagccttaggctttccctgatgaccttattggaacagcacacttcccttcccctgatcacttactgtttccatcctgctttttttcgcttcataacccttatctctacttgaattttatatattcactgctattatgctgagtatctagtacagtgtttagcacaaattggagctcagcagatgtctgttgaatgaataagctattctagaatgctttattttttggaagatcgtatgtcttatttggcttaatatttttaaagaaggaaaccactttcttgcctaggagacagtgattattttggaagaactttgtagatcattcactgccaggattacttactttgtctttttttacattacaggatgctaatgaatgttggatacaaatgatgcgagtattgcaacagaaattggaagcaatagaggatgattctgttaaagaggtaattgaaatatatttgtgattatagactttcgttataccttgatttttttttttattttttttcccctcaaaggcttaaaataagttccatcttataggtagatgtgtatttaaatactttagatgctcaatctgtagtcagaatttggaagcttgcatacgacatttaaatttaatgtattatttattaaacttaattcattgttgatttttggtaatgttttttgaaggattttactgtaagggactacatttttaaaaaaatatgtattactaaactggattgtgtggaagaaaatctacattaatatttatataaagttggaatttttattttaatttttgcagacagactcctcatctgcatcggcagcgacaccttctaaaaagaaaagtttaatcgatcagttcttcggtgttgagtttgaaactacgtatccttatgagccaagatatagactatactcataccttattagaattggcataaatagcatcattggctgattgattggtggtgggtagaagaaaaattcttcagaggttttttttctttgagacggagtttcgctcttgtcgcccaggctggattgcaatggtgtgatcttgactcactgcaacctccacctcctgggttcaaacagttctgcctcagcctcccaagtagctgggattacaggtgcatgccaccatacccagctaattttttgtatttttagtagagatggggtttcaccctcttggtcaggctggtattgaactcctgactttagttgatctacccaccttggcctccaggtgtgagccaccgcgcccagcccagaggtttttatacctaaaaaaatacaataatggaaattaggaatttggaaaaatatacctattggagtgatcttgaaggataatgggattattcattatgttttgattaatataattattttaaatttatttcttgaaggatatttattattttttcctaagaacatctttagcagagtctacctcattttcattcaccttataaagaattaatttcttatatgtcaaggtgactgttaataataacttttaaaataaaaaaagaattttttaattttataaaagggtgtgtatcaactatacatgagattgaaccagttaataaaacatgaatcaggaaagtactgtcttctaggtcatggttagaaaaacttagaaacaatttatgtacctttgggcttctaagaccattataagaccatactaaataccagcttatagtttagagtttattgcagtttatcttttaatacacatttattactcattgttgtttctagaattgttggtagccaaatgaacattcttaagtatgttgaaatgaatcttgggagactaaaaggttttaaatgccaatgaatgatactattaattttaatggaattaggataatgtattatattcaagagtatataacaaattgaatacccgttggcatattccttatcttagtttacaaagcatgaaatgtacagaatctgaagaagaagaagtcaccaaaggaaaggaaaatcaacttcagcttagctgttttatcaatcaggaagtcaagtatctttttacaggacttaaattggtaaggacaatctcagtccatccttgttgtttgtgaattccatgtttgcgagtaagccaaagtcattattcactgggctttaatggtcatttgtagacatgtgcagagcaatacgcattttgagttgcccgatacacacagtcccatctgaggtcaaacaagtacttggccttcttgtttcagcttggtaaacaaataccattttagcaggaatgttagaactgttgttttaaaaaaaaatttctgctttttgttggttatttcactgtttaagatgaccccccaagcacagggctgagtgctgtctagtgtttctaggtgtgggaaggctgtgatgtgccttactgagaaaatatacttgttagagaagcttcagttgggcctgcgttgcactgttggctctgagttcaatgttaattaatcaacacaatatgtgaaataaggtgtccttaaacagaaacacacataaaacaaggttatgtattgattggttgatgaaaatgttgtgatcaaaggctggcgggaatctaatcctgtatttcccctaggagcagtggttcagtattcattgattcagtgcttgtggtgactttgtagaacataattaccgtgactaacaaaatcaactgtatagtcagaaatcaaacaaacttcaactagctcttcatttcatagacaaaagcattattgacatggttgcatatgctaacaaatattgggacatctcactttttaatcactgggtgttcctgcttcacactgtgaagaagcacctagtgctttgtgctgtaccttgctttattttaaagcactcaagaaatgtttgttgaatagtttacatgtttgttaagatttttccttagagatagttgttttcatgggccctataacttagctgaactgttaactttaaggaaaattacttaatctaagctactgttttcttacgtgaaaatgagagtaactatagggttgtttgtgggtttgtgctcttaaccattaagggtgatcatataatgtattgtctaaaccaggacactttggtggagagtgaatgagggtatgttagtaattatgcaatataaactgggatttttctgtgcaaatcagggcatgtagtcgttctgccattgcactgtcttgcagttgaggccctggaatttaaagtaacctaattggcttttggcagagccagaactagaacttgcttctttcattattcagttagtgctgcttttccagtgccatactaaagaatacggactcacataaaatgtcagcttccactctgctaataagcccatggataaaacatacggttttgcttgctgacttactaatttggtgtgctttggggatatgtatatctctcgaaggatctccccatttgaactgataccttttaatagttttcaaattatagttcatgtgattccacttcaaaagcactgataattaggattgtttattttattttattttatttatttatttacttattttgagacggagtctctctctgtcacccaagctggagtgcagtggcacaatctcggctcactgcaacctctgactcccaggttcaagagattctcctgccttagcctcctgagtagctgggactacaggtgcgtgccaccacacctggctgatttttggtatttttgatagagacagggttttgtcatgttagcctggatggtctcaatctcctgaccttgtgatccgcccacctcggcctcccaaagtgctgggattataggaatgagccaccgtgcccagccaggattatttattttaaaagttagcttcttcctaaacacagttgtatgaaaaataaatgcatgaataaaagttagccattgcaacatctagatatttgaagaagggcctggagggcagaatttttaaaaatcctggttgatcctctttgctgtctcctctaaccatgaccaataaagagaagtcttgaaggaagaaaagtcagtgaaaaatgatgagacattggaataggtcctctgtgcagaggcctagtttgggcagaggaggtgggttgataaacactgaagtgggacatggattatgttgataaacaagatgatttgttatctgggggctctcatctatagtttgggataaggttggcaaggggaagggttgttaaagggcataagaagaagagtgagtgagtcacgctctgtcttatgataccgaggggagagttttgagccagtgtggatatgaacatggtgacttttaagagaaattcatttaaaaacacacaaaacttcttaacccccaggagccaaatcatgtaaggcatggtgtgcaagtttcaggatataccagcaaatgaagtctcagtgttaactggagagtgtggagtggagtgctttggcagggactctccaggatggtattttcttcacaattttgtaaaagtataggaaaaccgaacatacccagaaggtctagatgatagtggattggtggtaataataagatttcaccagatatactttcttgaaaaacctgtattcctagaatgtatttatttcctttataacttttaagatattttatcttttgttctgataattcttgagtaatttggcttcgtttctccactgctttgctgctgaataaacttggttaaatgttaaaaagctactccacagtgattccttttgtaatatgattagtaattttaaaaaatcagactttaaaattatacaagtgtaacatgcttaaacattaccagtaggttattttaattctaatttcttttttgtttgttttcttaaagcagagcacataagtagtgctaattctttctgtgacattagaaatagtagtgaatgtttgttaaatgtagagtatatgccaaatattttaccaggttttctacatgtactgactgtaattctaacaataacactataacattgattaccactaccaccttttccaaatgatgcccagagggataaataccgtttccactgttacacgggctgtaagaagcagaaaggtgatcatgctggttaagatatgtgcagcagctaaaggctttcccacatctgttaggttaacagaggtttctgtgttatgacttttttcaaatttaacaataattcattggtgctgattggcttttatgcataaaacgtaaagaacaggagtttcttgggctctcttaattttcctctagagtgaatattctgataataaacaggaatgacagctttgttatataaaatacaatataaaattctctgaatctaagcatcatttggggcatagctaaaaaagagcaaacagtatttacactcggaggaatccacaacaacgtaaattatttgatgccttgtaagaattgaacagtatctaaaagtcttcccatattgtcatcaaattgtgtctcagtggtataaacccattgatgtactgtatattgcctcttaggtagtgctagtttttaaaaggcttactggtgtgattctatattgcagaaataaaatttttaaaactaatgtttggtcttctgttatgttctttcttagcgacttcaggaagaaatcaccaaacagtctccaacgttgcaaagaaatgccttgtatatcaaatctgtaagttatgcagtcctttcgaagccaaattccgcttcactgaaatatttccagttaattaattttatccagtcttaatttttaccaccaaataattaaaacttgtatggtattttgatgtaatgggatttctttacattttgtctcctcagtccaagatcagccggctgcctgcttacttgaccattcagatggttcgatttttttataaagagaaggaatctgtgaatgccaaagttcttaaggttagtaatgaactttactttgtataagaaatgtaattctttgaaggtaattgctaactcacaattgctttcattattcctttaggaatagttaagctttctttgaaatatttaggggagctaatattagacaagtgattcttaactcagaacgtatattagaattatctattgtcttttttatttttaactgtacacacacctggcttctccctcacccccaaacatctgggtaggtcttcggtggggcctaggatattatatttttcaaaagattcatatacaattctgatggctctcctgcactacccagaaatagtgccctagaccacgtcctcagcttcagggatactgattcagtaggcttggagatgggtgtgaggtagggagtgataactctgcactatactctaggtggtttctttctttttttttttgagacggagtctcgctctgtcacccaggctggagtgcagtggcgctatcttggctcactgcaagctctgcctcctgggttcatgccattctccagcctcaacctcccgagtagctgggactacaggcgcccgccaccgtgcccggctaatttttttgtatttttagtagagatggggtttcaccgtggtctcaatctcctgacctcttgatccgcccgctttggcctcccaaagagttcctttctttcaggtgaaaggagaaagagttaaatcactggtgcccaaagagtacttaaattgtaatcccttgatttaggatccagcctcagaatctgactgtttttgttgagttgtagttctgctacatctccatagagtcctgggaggggcctatctatcattttagccttttgagcttaaattcttagtatattttccagtatacttagcgttgtatgagaaggttaaatgtagttgaagtatctagtgttgtatactttaaatatatactactataagctattgaactatatcactattacttctatgtaaagttgtatttcaaataaaaaaaaaaaaccataagtttattccagtttgggaggtccattattttcacagcagcttgtccaatatttctgagatgtttcttttctcaggtaaattttggtacttcctctgtggttagttttgtgggttagagtatttaatggaaaaacatgttttagaaatttctcaccttaaaaaagttagaaccagatcattcttgaaaataggcactcttaagaggtttcaactgcagatttccaagtgattttcacagattttattttcaactgtatctgaattatgaaagcattacttcagatatgtgatactttaaataaatatctttataaatgtgtttacacatgttttttgtttgtttgtatataggatgttaaatttcctcttatgttggatatgtatgaactgtgtacaccagaacttcaagagaaaatggtgtcttttcgatccaaattcaaggatctagaagataaaaaagtgaatcagcagccaaatacagtaggttcttactgctgactttatactcttaatatcttaatctcccatcagtgctcagcaattactctgtcttttttttcctgcttcatttttccttcagaactatactttgtatagtattatttggatcaatctgtattacaattagcaggtatacacatcctccatatatcagtgcagatctttaaagttttgcatgtgttttattttcctttttttttttttgtgacaaggtcttcctttgtcactcaggctcactgcagtctcaacctcccaggcgcaaatgatcctcccacctcaccctcccaagtagctgggaccacaggcgtgcgccaccatgcccagctatttttttgtatttttggtagagacagggttttgccatgttgctgaggctagtctcgaactcctgagctcaggcgatctgcccacctaggcctcccagagtgctggggattataggcatgaggcaccacacctggcctttaggtgtattttagcatgagaaacagaactctacttagaataaatgagtcctttgtggtagaataagcttaatattttccttccccctgtaatctgtagctcatattccttttatacttatctcctcaaagtacttcacgtaaaaccttacctagtgttgaccttgatgcagtcaaaatacagtacatttccatcaccacaaagatcttgcattattgccacagggccacttttcttctgccctaccccttccttaattcctgacaactaccaacccgttcatttctataatttttgtcatttcaagaaagttggccaggcatggtggctcacgctagtaatcccaggactttgggaatctgaggcaggaggatcactttaggccaggagttcgagactgtcctgggcaacgtagtgaaaccctgtctctacaaaatatgaaaataaaaaaaatcagttggatgtggtggcatacaccggtagttctagctacttgggaggctgagatgagaggatcgcttgagaccaagagttaaatgctgtaatgagccatgattgtgccacagcactccaacctgtataacaaagcaagactctgtttctaaaaaaaaattatacaaacgaaataaaaactcttccactttttaatataacctttctcactcagcataattctctggcgactcatccagggtgttgtgcatatcagttgctccttccatttcattgctgatcagtattccctggtgtgaatttaccacaatctgcttcaccattcacctattgaagaacacctgggttgtttctagtgtttgtctgtgatgaataaacctgctgtaaacattcgtgtacaggttttaatgtaaacgtaagttccatttctctggaatgaatgcctaggaatgcagttgttagattgcatggtagttgcatgtttagtttttcaggaaactgccagatgttttctagagtggctgtaccattttacatttccaccagcaaggtgagactgattcactttctctgcattctcaccagcatttggtgttgtcactatttttcatttcagccattggataggtttatagtgatactgtgttttcctttgcaccttcctagtggctgatgaagttgagcatgtcttcatgtgtttatttgctatctgtatatcctcttttgtaaaatgcttcctcttgtcttttccctattttctaattgtactgtttttttactcttgaattttgagagttctccatattctagacctttgttggatatgtggtttgtgaatattttctcctagtctgtagcttatgttttcatcctcttaacctagggtcttttgcagaagaaaggtttttttaatttttatgaaatccagtctatttttttctttagttgcttgtgctattggtgtcatatctaagaaagcattgccgggctcggcatggtggctctcacctgtaatcccagcactttaggaggctgagacaggcagatcacttgaggtcaggggttcgagaccagcctggcaaacatggtgaaaccctgtctctactaaaaatacaaaaaattagctgggtatggtggtgcggacctataatcccagctacttgggaggctgaggcaggagaatcgcttgaactggggaggcagaggttgtagtgagctgagatcacgccactgccctccagtctgggcaacattgcccagtccatgccctcagagatttatacgtatgtttttttctgagagttctgtggttttagttcttccatttaggtctttgatccattgagggttaactttttatatagtgtgaggtgtgggttcagattcattgttttgcatgtgaatatctggttgtctcagcaccattttttaagaagactgttctttgcccatcagatggtcttggaacctttgtagagattaatttgaccatctgtatttatgagtgtatttctagactattaattttattccattggtctatatgtctgtcctgatgctcataccagactgacttgattactgtagttttctaataaggcttgaaattgtgaagtatcagccttcacttttgttcttctttttgaaagttattttagctattctgagtcccttgcatttccatgtatattttaggatcagcttgtccatttcttcaaaaaagattgacggggattacacggaatctgtggatcaattaaaaagtattactatcttaatagtattaagactaatctcagcactttgggaggccaaggtgggcagattgcttgagtccagaagttggagaccagcctgggcaacatggcaaaaccctgtctccacaaaaaatacagaaattagccaggcgtggtggcgtgtgcctgtagtcccagctgttcagaaggctaaggtgggaggatcacttgagcatgggaaatggaggtcatagtgagccaaaatggtgccactgcactccagtctgagtgactgagtaagactgtgtctcaaaaaataaaaagtattaagtcttacaatccataaacttcatgtgtctttctattcatttaggtctttaatttttttcataatgttttatagttttcagtgtacaagccttggacatttttggttaaatttattcctaaatagtttattctttttgatgcttttgtaaatggcattcctttcttaatttcattgtctagagtggctagtaaagctagcatatagaaataaaattaactttgtatatggatcttaaatccttgactttgctgaatttattagctgtttttatccattagtgttttgaagagattatgtagaattggtgttaatttttttttaaacatttgatagaattggtggaacagtctgcttagagattttactttcaggagttttatttgtttattttattttattttatttttatttattttttttctattgcctaaacataggcaggcacattttcaggagtttttacatttcaaatttaatttccttcatagatatagggctattcaaatgatctatttcatattgtgtttgtttttgtaaattgttttcccagaattgatccatttcataagcttatcaaatttgtatgtagaattgtttctagtatttattacccttttgatgtctgtagagtgtttagtgagtgagatccatcccgtttcattgctgatattagtaatttgtgtttgtcccccttgcttgaggattattaattttattgatatcttcaaagaattggctttgtttcatggatttttctctattttctgtttttagttgtattgatttctgctcttatttcctttattctgcttgccttgtgatataaatttccctttcagcagtgatttcactatatcctatgaattttgatacatggtatttttattttcattctgttccttgtatttttaaaaatttatcttgagacttcctctttggccattggttatttagaagggtctaagtaattttcctgttatgtttctgttgattctagtttgatgccattgtggtgacagaacacacttacttgatttaaattctattacatttatttatttatttgagactgagtcttgctctgtcgcccaggctggagtgcataggtacgatcccggctcagtgcaacctctgcctcctgggttcaagcaattctcatgcctcagcgtcccgagtagctgggattacaggcgagtgccaccatgcctggctaatttttgtatttttattagacacagggtttcatcatgttggccaggctggtctcgagctcctgatctcaagtgatccactcgccccggcgtaagccactatacccggcctaaattatattaaatttaaatgtgatttaggtatagactatttacatttagtgcaatcatcgacatgttagggtttaattctgcttttttgatgttttgcctttttttttttgtcttcttgtgggttacttgaactgtgttttagaatcctgttttactttatgtttttaaatgtgtttctttgtatagttttttcagtgattgctgtaggtgatttcattatctgtataaaaaagatgtgattaacctagttgccattttttgttgtggaatcctttgacttcttgccatcacagctacctgtaagctgctggcattgtcttcattaccattatagttttaaagaactttgtgctgtattcctagataagttatttttctcatgttgcatgctaaaatgagttgaagcagtgagttcctcctaagagtccttgtctaatttaaatcatacctctttaatgtaggtaagtctttgctgaaaaatatttcagttcatttgtgctggcgtggtaagtggacatggctcaggaggtttaatacaaattgcaggaattcttgttttagaggtagttgttttttccccccacctctgtggtttgacagtattttggtaacactggggaattgggtttttccttttctgccctagagcactgtttaactgtactgctgtattcactggtacgctttcactttaatggtttaaaattggtcatcacattcagggtgtctgttactgtactgtaacaagattttatattgttgaagtgtaggactgctgggtttacagttttaactgtggttatatcattttagtaatttggaaggtagactgtattttgtctctgtgcactgtagacagtaaatatttatgaaattgaacacttacagagaattcaaattttatttccaaaatcatgatttaaaattaaacatttttttctcctcagagtgacaaaaagagtagtccccagaaagaagttaagtatgaacccttttcttttgctgatggtaagtaacattctcattttaattgagttattgtatgtgggtctttttaaggtaaaatttacatcttaccccatatttacttattctgatgtgcttttcaaacaaaatgtcaggtttcttgaacaatttaccttaatgacatatagtaaatttactcattggcatacagttctatgagtaagttacttattaaaacatcaatcatgaagccttaactatgattggacagtagtatcttattggattctgataatactttcgtaatgtgaactttagagttattcttgttacttagcttgagaaggcacatgtctattcattgtctaatattaatggatttacatctttctttagatattggctccaataattgtggatactatgacttacaagcagtactaacacaccagggaaggtctagttcttcaggtcattatgtatcatgggtgaaaaggaaacaaggtaaagggtattcttttttcaactgttcaatattattttaacagttcatttattataaattttatagcagtgtggttttcaaactttgggtctcagaaccactttacattcttgaagccccaaagagctttggtttatgaggtttgcctctcttaatacttactgtattagaaattaaaactgagaaattaagaaagttagttttaaaaatgatagtaataagcccattacatattaatgtaaaaacaaaatgagtgagaaatggtactgatttacatttttatgtctttctgttgtctggcttaaataggaggcagctgggttctcctgttagtgttcgcattcagtctgttgcattatcatacattatgtagcctctggaaaattccagagtacacttgagagaatgtgggtggaaaaggcaagcagtgctctagtggtgtcattgaagtagttgtaacctggtggaacccctgcagtgcccttaagcctgtgtggtcactgggtcgcacttggaggactgttggtgtggccagtggagcactgctgtgcctccgatgacttgatactttttttgcagtggaactctgagacgaatcctgcataacattaattcatcttcttgtccctgttatttagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcaagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatctcaacattagagttgtgctagattactgcttgactgactagctaggttaggcctaagagtgtttaccgaataatctgcactcactcagtagcccttcttcaggattaaaaacgatgatgacctcatcttagagccctaaagggaaatgcttat

SEQ ID NO: 2608 - DNA, 55258 bp, Homo sapiens; identical to SEQ ID NO: 2607

SEQ ID NO: 2609 - DNA, 58473 bp, Homo sapiens
caaaattccttatccaataatacataattaatttttattaacagtccaggatttgtttagcatcttgtttaacatttgaaaatcaaaacataaactttttggttctcaaggatagtgctattaaaagaaaatcttgaacatcagtggttagtaattttttacttacagaacaaaaacttctgaaatttcattgtgggacttaatctatttacattcctaaaactgagaataattaatgtatttgagatccttgtatgctagtatacattcataaggttctactgttctcatgaagccatttgactggcaaacatattcattacagtttcaaaagaaaacaccctatttgactcaccagaaaaacctttgtgatctatatcctactatttctgctgctgctgctgagcatggaatacatgtggggttgaaacaggggaggaaagagatagatttattagggtaataccaacttttatggctccccctgccccctccacctaaaattaggaggtcagtgaaagaactgcaaatgaatgtaaagaggaatatttcctgtactactgtagaaattttagagattaaaaacccctatgatttgttctgtaccttttgaacaatgaatgacacccctcccatctattttccaattttatagtaaaaatcggatttagaatcagaatctaaaattttcctttggtgtaaaaaatagttttgcattttatgaaaacaattgtccttttaaaaattaatcacatatataattgaatatattggttgcatatcagaagaaaaggtttaaggattaaagcattcaaagaacagtaatttggtggaatttcagtcagtgttatgggatcatgtcagagatgaacccttttatcaaaattccaaaggtggatccatattttataaaatttgataccaaataaattatgttataggaagatttcaatattgtctcaaacactggagaaaaaatttaatatagtcaaattacatgaaaaggcaagaatactgatcatgttgatggtatttctaatatttggaaaatgttataaaaaagaagtataaatactattcagattctgaaaaccatggcagacgcaaaattaaataaggagtaacagtaataaatgaattaaaaattagacaaaagcatattaaatgacaaaacagcaaagcaaaaatagaattgtcattaatattaaatagtatactgttgtaaaatatatgaaagtattaaaagtattataattaaaaatgattcttatcctaaatatgaaaataaatatcaaataatatgaaacataacatctaattgtttgataagaaaaaataacacaaagcagagaaaataaaagacacctcactattcccaatgtggttattatttatggaatggataaaacatgttgtagaaaaggtcattacagttaggttagcacataaaaaaccaacatgccacatctacctaaataattttgtagaacagctgaaaaagcaaatttcatcaaatttagacagcttatagtggaataactgagtatggtgaggtattaactaacactaagtttcacaacgggcagcttctagctggttcgttgaagctggatctcggccacgcaaggatcattggacaagaaatcagttgagctggaatagagctgcccaattgtcttaataatgaatgctccacactgtctgttaagtaaagagaaaatatagatcaggaagactgaatggaaaaaaaaagataagttagaacagatgagtacagaccatcaatcaacattcactaaatatttgcagaaccttggtaccaattaaattagaatgttacaaagtgagaggctagcaatttaggagggctccagaactcaggaaaacctgctctctgagagcttagaatctatattagacaatctctagtctagtgttacagtataaatgttgagtaaataaaatgagggatgggtcagcacagattacgagttacaacatttccttctattaggtgggtcttaaaaacttgtttttaaaaggggaatagtatttttggcaggaggctatttagaacgctgtccaggggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgtgcaccgtgcgcaagctgaagcagggcgaggcattgcctcacttgggaagcgcaaggggtcagggagttccctttctgagtcaaagaaaggggtgatggacggcacctggaaaatcgggtcactactgcgcttttccgacgggcttaaaaaacggcgcaccacgagattatatctcgcacctggctcggagggtcctacgcccacggagtctcgctgattgctagcacagcagtctgagctctaactgcaaggcggcagcgaggctgggggaggggcgcccgccattgcccaggcttgattaggtaaacaaagcagctgggaagctccaactgggtggagcccagcacagctcaaggaggcctgcctgcctctgtaggctccacctctgggggcagggcacagacaaacaaaaagatcagtaacctctgcagacttaaatgtccctgtctgacagctttgaagagagcagtggttttcccagcatgcagctggagatctgagaacgggcagactgcctcctcaagtgggtccctgacccctgacccccaagcagcctaactgggaggcaccccccaccaggggcacactgacacctcacagggcagggtattccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgtctctcctcctccaaaggaacgcagttcctcaccagcaacagaacaaagctggatggggaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgaagaagcctcaggagccaatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttgagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcttttacagacaagcaaatgctgagagattttgtcaccaccaggcctgccttacaagagctcctaaaggaagcactaaacatggaaaggaacaaccggtaccagccgctgcaaaatcatgccaaaatgtaaagaccatcgagactaggaagaaactgcatcaactaatgagaaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccacctcacttgcagagacacacataggctcaaaataaaaggatggaggaagacctaccaagccaatggaaaacaaaaaaaggcaggggttgcaatcctggtcttggataaaacagactttaaaccaacaaagatcaaaagagacaaagaaggccattacataatggtaaagggatcagttcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaacagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaactgctcaaatacatggaaactgaacaacctgctcctgaatgactactgggtacataacaaaatgaaggcagaaataaagatgttctttgaaaccaacgagagcaaagacacaacataccagaatctctgggacgcattcaaagcagtgtgtagagagaaatttatagcactaaatgcccacaagagaaagcaggaaagatacaaaattgacaccctaacctcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgagcccacagaaatacaaactaccatcagagaatactacaaacacctctacgcaaataaactagaaaatctagaagaaatggataaatttctcgacacatacactctcccaagactaaaccaggaagaagttgaatctctgaatagaccaataacaggagctgaaattgtggcaataatcaatagcttaccaaccaaaaagagtccaggaccagatggattcacagctgaattctaccagaggtacaaggaacaactggtaccattccttctgaaactattccaatcaatagaaaaagagggaatcctccctaactcattttatgaggccagcatcattctgataccaaagccaggaagagacacaacaaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaagactggttcaatatacgcaaatcaataaatgtaatccagcatataaacagagccaaagacaaaaaccacatgattatctgaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacggggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaggctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaagaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatagagaccaatggaacagaacagagccctcagaaataatgccacatatctacaactatctgatctttgacaagcctgagaaaaacaagcaatggggaaaggattccctatttaataaatggtgctgggaaaactggctagccatatgtagaaagctgaaactggatcccttccttacaccttacacaagaattaattcaagatggattaaagacttacatgttagacgtaaaaccataaaaaccctagaagaaaacctaggcaataccattcaagacataggcatgggcaaggacttcatgtctaaaacaccaaaagccatggcaacaaaagccaaaattgacaaatgggatctaattaaactcaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaaccagttcaaccattgtggaagtcagtgtggcgattcctcagggatctagaactagaaataccatttgacccagccatcccattactgggtatatacccaaagggttataaatcatgctgatataaagacgcacacgtatgtttatcacggcactattcacaatagcaaagacttggaaccaacccaaatgtccaacaatgatagagtggattaagaaaatgtggcagatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaaaacttggacacaggaaggggaatatcacacagaggggactgttgcgggtggagcggggagggatagcattaggagatatgcctaatgctaaatgacgagttaatgggtgcagcacaccaacatggcacacgtatacatatgtaatgaatctgcacgttgtgcacatgtatcctaaaacttaaagtataataataataaaattaaaaaaaagaattctatttaaagtctgcataatgaaaaatgaagcagaaaattactgcaaaaatacactgtacattcttacaaagtgaaccattgagataactatttccaggttacatgatacatttgaggtaaaagttactgtaaaatttatttaaaaaaatggataagatcaaggggaaatgtgatctattttctctctttagaagcttttggaattttttctattattcctgccattctgaaatttcacaataattggccttagtgtgagtcttttgcagtaattgtggcaagtagttggtaggccttttcaatttagagactcttgtccttaagtttctaggaagttttcttctattaatttattgataatttcctccaatgatttttctctattcctctttctgcaatttaaaaaatatttgacttctgggattaatctaattttatcttttctctattattattcacctcagtcttttttgattctacgttctgaaaacttttgcctgtaatatttaactcacacataatttatttcaattatcacattagtggaaaaactagtgacattttagaataaggtgtatagtttagacgactgtactgatgttcatttcctgtgcctgtgccctctagccaaaggatgaagtaggtgaaggatatacagaaactctattatttctataacttctcagtaaatctgaaattatttcaaaatgcaaggctaaaaaaattaaaaggacagatatttgagagaaaaagtatcaggctgtctatgcatgtcccacttctcattagtttttgcctgtttcggagaggatattaattgtagtttctttgatattttcttctgctccctgcattgtatgtttcttatgaatttctttttttctgtttattttgttctctcaccctagaggttttcttctaacgtggctgcacgtcatagttaagagggaggcactaaaatcctaatgggaagttctttgtgcatggtttgtcagtgatcttcacttcaaggatttaagagaccatcgaactttttctctgtggtagaaagcatgcttggattagaatcctggatctgccacttactcaactatgctactgtgggcaagttactttttaagcttaaagtgatcaaattaacactgccagtaattagacatattggcatctcatatcccctgatatgacacactgataagggcatatcacctctgtgatattattgtcccaaattcataccctttatctaattaagagaaaacataggccaacaaaagtgaagagtgttctacaaaataactaatcaatattttaaaaaagaatcaaggtcatgaaagacaataaaagactatgtaaatgtcacagattggtggagaataaggagacatgacaaattaatgtaggatcttagattagatcctagaacagaaaaagaacataagtgaaaaaaatggtgaagtttgtagttcacttaataggtctgtagtttacttaacagtactttatgaatgctaatttcttcgttttgctaattgtttcaattataagctgttagaagttgagtgaagagatacatgaactctatgtattatttttacaacctttctgtaagtgtaaaattattttaaaataaaatgttaaaaaataggttaaaaggccaaggacatttggtgggatgggatgatgggggaggataactgccaggatatctatgcatgggttgcttctcattaattttgcttgaggcatgatgaatccttttttgatttgtaaattcaagtcacagtgtttttgattttgttttgctgttaaaatttctgcacattctttctgttccatttattctgtattcttttcttgagaattactatttttttggttggacctgtctctctgctctctctattctagcattttatctcatcatttaatctttcatgttattttcttttacattctggaagaattaaaaatatccctctctatgaaggatttcattttcttttgtgactactggccctttatgacaaaggcaaatatgattctttccatcatgtcaatagtttttgggcagtattttcttacactagccagcaaccatttcatttttcctgtttttcagcttgcaattgtttcttaaagatctattactgagaacatgggatacatcttaaaaattgtatttaatttcctctaatacatacgttcttatacatatatacatatttatactattcatccttgccttcaatgtagtgccatattcaattttttttcacagaatccatataatacatacttttctgtttactcatccttgaatggggatctactcatgacaattagaattggtgtcatgaacacttgattctccttactgtccttacatcaaaaaggagtcttggtagacacagaacctatacaatttctaatgtctaagtgggtgagcattttttgctcctcctgcctagttctttatgagtaaaaaacttattctagagaatctgaggctgtctattgtttgactatatatagcatacatgaaaatttataccctccttatatattcagagcttttcctgcctctgtcctctagattacattgctttatacttgtccttcccaggtttttcagaatacaagacaatttgagtctctaaattgattcataagtattaatgatactcaaatgaggaaatggttgggaaaaaaatactggtagtggaatctttttgtaaagcagatatagttgctaatttttaggtaagtgcacgctctgggcctctgaactagaagtagatagtggtagtagttcagatccctctccaatttacttctgaatcatactttgtcgaccattagttgtgtttttcatttaagtccaatcagtattttacttagaagaaattccttatagcctgggcaagaggttaaatatgatccttaatagccatatgttttcatcgattgttagtagacatgggagttaaataaaatacacattgaacttaatccatataagaacaattttattagatgcttatattaatgcaaaaatgtaaaaacactgtaagaaaaccaaaacacttgagaattctccacttatacccttcataccttgggatttgatatttatcttagaaacataatagttcacatacccagaaacacagattttccttttgttccttcctagtctagttcagtgggataattttgacattatgtggttttgctttttttgactttaaaacttaattctcttttatttcttttttaaaattagagatggggtctcgccatattgccaggctggccttaaactcctggctcaagtgatcctcctgccttggcctcccaaagtgctggggttcaggtgtgagttaccacacctggcctaaaacttgattctgtataagatgttactgctgaattagggaatgatggccctaattagtattatattaatctagttacctctatattggtctgttttgtatttattcgtttttgtatttgatttgacagagtatgtaggctgtggcttacagccaatgagtagtttctggtaaacagtacttcacagcagttagacttgtgcttcaaactctgcataaggtttctattttatggaatagatttgttgcttcaagataattttgacatttgaaattcctactttgggatatcttcaattaacattcatgagttgtaatcattagagctttaaaaatgagttttacgcttataaaaacaacaactcctccaaagaatatttccacctttctattttaaaagtcaccaagatttttggtactagagaaaatttgcattggaagtaaaaaaaggctaatgtttcaaatgtcattcactaatattttaatattagtaatatgttctagaaaaagattgtttcataatgtagaacaacatttgtatattaagatttccatgttataatagaaatgcactgtaaatgaaaatagataatttgccacatagtaatacatgcatattaaagcatttctacagcattatatagttctagaaaactacagaagtggttttggagtttctgtctctgagtggggtatcgttttgtattgagggccactaagtcacctaaagaaaaatattgagtataaaatgcatagaacatttaatcttaaaaaataaaaatgagaaacacaaaattctacataactatcttgtgctccagttttgactttggaagtctatttttttccatctctaacaaaagaggaattggtaattattattatttttttattttagagatatacatggtttcactctgttgcccaaactagaatgcagtggcgtgatcatagctcactgtaaccttgaacctttgggctcaagtgatcatcctgcctcagcctcctgagtagttagcactataggggtgcaccaccatgcccagatagtttttaaaatttttattttgtagaggctgaggagttagcactataggggtgcaccaccatgcccagatagtttttaaaatttttattttgtagaggcagggtctcactatgctctcaaactcctggcttcaagcaatcctcctaccttggcctcccaaagtgctgggattgcaggcatgagccaccacagttggccagaattggtaatctttatatgactatattaaagagtaagataccagtttctctgtacaatttctgatgttacctactcacagatctaagaacatttagagaaatatatactcttaaactagaagaattaaattttaagaatgtttaacattaacatcctttggaaatttctcctatccaaataccacccaccactccatcctctattcaaattattcaatttgtataattgtataaattacacaatttccatcactttgtgatatagctctctctcagtaactgaaaataactatcacttacataatatggcatagcaacatcagccatttctgcaaaagtatatttggagtaaatgttaacgacagaagaagtctattttagaagattttctaacaatactaaaaatgaagcctctatgagtaatgtttagtaacactataggttttgacaatatgtcaaaattatggttttatttcatgtttggtgtatagtgataaagccaatgaagggatgcagtgagtggtaatggcagtgagtggtaatggtgtgaagggtcacgagaagaccgggaggctccttaaagtagactgtcttggtattgagttcaacacataggatgggccagaacataaatatgagtgtgaaatagctaatatccattattttaatgcaaagactatgcctaccttcctcaccaaagtacactgtatgcaggattcatattaccatctcaacagttgatcagtctgtggctctttactgcagataaagttcatttccttaaagggatgatgcaagagtttcaccaagaaacttgttcataagggaataggaagaattccctgtacatagtagatagtcaaaatatattgagtgtatacatgggtataactggattatcattctttggcctgaatctgactaaggaggcatgaacatggttcccaaactggaaaaggagatcattaattgttttcacctccccataaatgtcacatgtcatcaacatagataataaaaatcagagtactgtatattaaatatctagaataggcaaattcatatagatagaaagtaaattagaggttaccagggactaggggttgagaggaagcacataggaagagttattgcttaatgggtgcacagagtttcaacttgggatgaggaaaaggtttgaaaacaatggtgatggttgcatagcattgtgaatgtaattaatgccactgaattgtacacttaacaatggttgaaacagaaaatttttaagtttgaagtcaggtagcgtgatacctccggctttgttcttttggcttaggattgacttggcaatgagggctcttttttggttccatatgaactttaaagtagttttttccaattctgtgaagaaagccattggtagcttgatggggatggcattgaatctataaattaccttgggcagtatggccattttcacgatattgattcttcctacccgtgagcatggaatgttcttccatttgtttgtatcctcttttatttcattgagcagtggtttgtagttcttcttgaagacgtccttcacatccctcgtaagttggattcctaggtattttattctctttgaagcaattgtgaatgggagttcactcatgatttggctctctgtttgtctgttattggtgtataagaatacttgtgatgtttgtacattgattttgtatcctgagacttttctgaagttgcttatcagcttaaggagattttgggctgagacaatggggttttctagatatacaatactacaaggctacagtaaccaaaacagcatggtactggtaccaaaacagagatagagaccaatggaacagaacagagccctcagaaataatgccgcatatctacaactatctgatctttgacaagcctgacaaaaacaagaaatggggaaaggatcccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagccatggcaacaaaagccaaaattgacaaatgggatctaattaaactaaagagcttctgcacagcaaaagaaactaccatcagagtgaaaaggcaacctacaaaatgggagaaaattttcacaatctactcctctgacaaaggatatctctaatatccagaatctacaatgaactcaaacaaatttacaagaaaaaaacaaccccatcaaaaagtgggtgaaggatattaacagacacttctcaaaagaagacatttatgcagccaaaaaacacatgaaaaaatgctcatcatcactggccatcagagaaatgcaaatcaaaaccacaatgagataccatcttacaccagttagaatggcgatcattaaaaagtcaggaaacaacaggtgctggagaggatgtggagaaataggaacacttttacaatgttggtgggagtgtaaactagttcaaccattgtggaagtcagtgtggcgattcctcagggatctagaactagaaataccatttgacccagccatcccattactgggtatatacccaaaggactacaaatcatgctgctataaagacacatgcacacgtatgtttattgcggcactattcacaatagcaaagacttggaaccaacccaaatgtccaacaacgatagactggattaagaaaatgtggcagatatacacctcggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaacacatggacacaggaaggggaacatcacactccggggactgttgtggggtggggggagtggggagggatagcattaggagatatgcctaatgctaaatgacgagttaatgggttcagtacaccaacatggcacatgtatacatatgtaacaaacctgcacattgtgcacatgtaccctaaaacttaaagtataataaaataaaataaaataaaaattttttaaaaaagaaaatttttaagttgcatatattaccacaataaataaaaaagttaatagttaatttagaattatatttccttcacatgagtttgctaattctgtacttctgatcacaagtgtgatgtaaatatccaaaattgttcctttctagaagagaaagttggaaaacttgaaatatgatggaagaaaaacaaagtaaaaagtcaaaacaaatttcttactttaattggctcaggctgcatcacaggcgcaggcatagtgatggcacttggagcataaacctggtgatatgttgcttgaactccatgatcagaataaggctattacaaaaaaagagagaaaaaatgtcacctttcatctattaattctaaatatttactcagcatttacaatatactaatcatctagctatacaatgtagaaacagttaaaaacacatgcccttatgtttaattaacttataatctgatgagttaatataatgaattaacttatgaattaacttgtaatctgatgagggaaatagacagtagtcagaatgatcataaatcctatagacatgtatagggatgcaacaggcaagggaagagattatgtaaatgcagttatggcttgtccagcagatggtggtaccattcattggaatatagaatacaaggaaagcttaatattcatgtaattgtgtgtaaggggttgcagagcaggagttaggtttgtgatatacaaaatttgtggtatctgtaggaattctagtagacgtatactgttgatagatgtggctctagaccaggactgtcaaatagaaatacaatgtgagctacatatgttatttaaaattttcccattgtcatgttagaaaaataaaaaatggtagaattaatttttagtaataccttttatttaaactaatacatattaaatattatcatataaaagtacaatcaatacaaacattaccaagatgttttacattcttttttcttttttttttgagatggagtcttgctgtcttccaggctggagtgcagtggtgtgatctcggctcactgcaagttccacctcccggcttcacaccattctcctgcctcagcctcccaagtagctgagactacaggtgccgccactacacccggctaattttttgtatttttagtagagacggggtttcaccgtgttagccaggatggtcttgatctcctgacctcgggatccacccgcctcggcctcccaaaatgctgggattacaggcgtgagccattgcgcccagctacattcttttttcacactgtgtcttcaaaacccagtatgtattttacacttaggggacatctcaattcggtcttactgcatttcaagtgctcaactgccacatgtggctagtggctattgtagtggatagtgcagtctaaaactcaggagtgagacggaggctagatatatggctatggatgataacatcagagtgagtacatgtggtgaaagaatggagaatcaaatacaaaatctgcttataaaggaaaacaaaaggaggtaaaaggattgccagaagagagtagtatcatggaaaccaagggtaggaagagttttagggagtaggtacaatgtctctgagaggtcaaataagataaaaaagaaaggaaagtttgtgtcagttaggaagtcattgaggacctttacccaaggcagcttcagcagaaaggtaatgaagtagacttcagcaggtgaggagtgaatgagtagtgaagtagcagaaattctgaatgtagactactttttcaagacacttggctttggaaggtagcagaaaatcagggaagtggtgggagtgtgtgtcacaggataatattgcctcttacaaggtgctgcacactatacaaagaactttgtataccatctctctagtctttacatcaatcctgcaaaatagtttttcctgatgtcctcattttacaaataaggagattatgaaagcaagaccatgaagggttaagcaattcctcaaagtaacacagtaagttgtgaagctgtaaaccagtggagagaagaagacttcaaatacaagacagaaaaagaacagtagatggaatgaggtccctgaggaggagggaactgatagcatctagatcgcaagaggcagaaataaccttggacaagactgaaagtcactaaataaatataagaagctaaggatgagttacgatacaggtaaagtttgtgtttcaggggttggaggctgagttggttttcacaaattggttcttactctgcaaaagagaaggcaaagctatattctcagaatgacatgggcaggcagtggagtgggtgcaatctggtagtactgagggcttggcaaaggtttaaaataatcattgaaataagtgagtgaagacggtcacttttttttttaaaaaaagaaatttgactataacactcacaagaaaagtcgtgaagttcttaattttagggaaaaaaacacttcaactgtaaaccatcccactctattcattaagttatatattagtcagactataccctctactagaaacagtagcaaaacaaaaacatgcaaatattttgtatggaaataccacacaaagtacaagttataagataatgatgggcaatattttcagaaaagctttattagattccattaaatagtgcatatattctgatggtaagtatctgatatcagatattaaaaatatgatttaatgccaaaagagattctgacaaaaaatcaaatgtaaaagcattcttatctcactacctgctcctggcaaaccagaaaacaacaaaaagaacaaaatatagatttttaaaatgccatcatcaattaaagaagaaaatgcctatgactcccaaaccatacacaatgtagaatgtctgccaagtgctgtgcaagttggacgaacataagggaggattctgaagcctcctcagtcatgagaaaggatgacgatttcccaagaggtcaatgttctggaagacctcctcaaagatactttagagtcttgagtgcagaagtatgtattggtcagagtgaggtagaagcacaaaatatctccacagagatcctattcataattaggataataattaataataattaagaatcctgacttaacaggggaggtagaattgatggagaaatcatgtttatataatttttcttgtctactatctagccttttacctgaggaatactgctggaggtgaagcagggagaaagtgggaaaggaagtagcaattgccacatcccaatacagaacccctgtgataaaaagggctttacaaggaacaaaaatgatctctggcaaggatgtggaggaaagggaatccttgtacactgctggtgggaatgtaaattagtatggccattttggaaaacagtagggtggtttctcagaaaattaagaatactatcatgtgatctagaaatcccactactgtgtatacatatccaaaggaaatgaagtcagtatgttaaaaagatatctccatttccatgttcactccagcattattgataatagtcaagatatggaatcaaccttagtgtccatcaatcagtgaatggataaagaaaatgtagtatccatatacacaatggaatactgttcagccttaacaaagaaggagatcctgtcatttatgacaacatggatgaacctggaggacattatgctaagtgaaataagccaagcacagaaagacaaatactacatgatttcacttatgtgcagaacgtgaaaaagtcgaactcatagaagcagagagggccaggtgcggtggcttatgcctgtaatcccagcacttttggaggccgaggcaggcggatcatgaggtcaagaaatcgagaccatcctggccaacatggtgaaaccccgtctctactaaaaatataaaaattagcccggcatggtggtgtgcgcctgtagtcccagctatttgggaggctgggacagggggatcgcttgaacccgggaggcagaggttgcagtgagccgagatcatgccactgcactccaacttggtgacagagtgagactctgtctcgaaaaaaaaaaaaaaaaaaagcagagagaagaatggtggttgccagggactggggatggcgagtgagatgggagatgttggtcaaaggttacagggtttcagttctaaaggaagaatatgccctgaagatctactgtatagcatgactatagttaataataacatattatatacttgaaaattgctaagacttaaagtaccttaaatgttctcaccacaaacaaaaaaaaggataaccatgtgaggtgatggattagcttgattggggtaatcatttcacagtgtgtacatatatccaaccatcatgctatacactgtaaatgtataccatttgtcgttagttacaatttagtaaagctgaggataaaaagaaaaaagcaaccataaaaaagtaggtggggcaggccaggcgcagtggctcacgcctgtaatctcagcactttgggaggccgaggcaggctgattacgaggtcaggagattgagaccatcctggctaacacggtgaaaccccgtctctactaaaaatacaaaaaattagccagacttggtggcacacgcctgtagtcccagctacttgggaggctgaggcaggagaatcacttgaacccaggaggcagaggttgcagtgagccgagatggcaccactgcactccagcctgggcgacagagcgagactcgggctcaaaaaaaaaaaaaaaaaaaaaaaaggtggggcatgaaacaaataataaagaaatcctagtaaaagtattgatagtaaatcttaagatccaactgtggaaattattgtttcagaacaaaattataatattaaaaaagtaataaaacaatgtacttaaactgggaggtaaatgctaatttcttaatctttcaccacactgatttaaaacataccatgcacatggtactggtacaaaaacacagaccaatggaacaggatagagaactcaaataagaccacatatttacaaccatctgattttcaacaaacctgacaaaaacaagcaatggggaaaggattccttgtttaataaatggtgctggggaggtccagggcaagatggccaaataggaccagctctggtccgcagcttccagtgagaacaatgtagaaggtgggtgatttctgcatttccaactgaggtacccagctcatctcactgggactggttagacagtgggtgcagcccacggagggtgagcagaagcagggtggggcgtcacctcacccgggaagcacaaggggtcagggaactcccttccccagccaagggaagccatgagggacagtgatatctggctcagatactacgcttttcccatggcttttgcacctgcagaccaggagatcccctcgggtgcctacaccaccagggccctggatttcaagcacaaaactgggtgcccatttgggcagacaccgagctagctacagggttttttttgttcataccccagtggcacctggaactccagagagacagaaccattcactctcctggaaagggagctgaagccaggagccaagtggtcttgctcagtggatcccacttccatggagcccagcaagctaagacccactggcttgaaattcttgctgccagcacagctgtctgaagtcgacctgggatgctcaggcttggtcaggggttggggcatctgccattactgaggcttgagtaagcggttttccactcacagtgtaaataaagccactgggaagttcggactgggcagaacccacctcagtactgcaaagccactgtagccagactgcctttctagattcctcctctctgggcagggcatctctgaaagaaaggcagcagccccagtcaggggcttatagataaaactcccatctccctgggacaaaacacctgggggaaggggcagctgtgggtgcagcttcagcagacttaaatgttcctgcctgccggctctgaagagagcaacagatctcccagcacagtgcttgagctctgctaagggacagaatgcctccttaagtgagtccctgacacctgtgcctcctgactgggagatacctcctagcaggggttgacagacacctcatacaggagagctccagttggcatctggtgggtgtccctctgggacgaagcttccagaagaaggagcaggcagcaatctttgctgttccgcagcttccgctggtgatacccaggcaaacagggtctggggtggatctccagcaaactcctacagacctgcagcagaggggcctgactcttagaaggaaaactaacaaacagaaagcaataacatcaacatcaacaaaaaggacatccacgcaaaaaccccattcacaggtcatcagcatcaaatatcaaaggtagataaatccacaaagatgaggaaaaaccagcacaaaaaggctgaaaattccaaataccagaatgcctcttcccctccaaaggatcacaactcctcgccagcaagggaacaaaactggacggagaatgagtttgatgaattgacagaagtaggcttcagaggtgggtaataaactcttccgagctaaaggcgcatgttctaacccagtgcaaggaagctaagaaccttgataaaaggttacaggaactgccaactagaatagctagtttagagaaaaagaaaagtgacctgatggaactgaaaaacacagcacgagaacttcgtgaagcatacacaagtatcaatagctgaattgatcaagcagaagaaaggatatcagagatggaagattgacttaatgaaataaagcgtgaagacaagattagagaaaaaagaatgaaaaggaatgaacaaagccttcaagaaatatgggactatgtgaaaaggccaaagtttaggtttgattggtgtacctaaaagtgacacggggaatggaaccaaggtggaaaacacactcaggatattatccaggagaacttcctcaacctagcaagacaggccaacattcaaatttagaaaatacagagaccaccagaaagatactccttgagaagagtttggtgggaagcccaccaaactaacagcagatctctctgcagaaaccttacaagccagaagagagtagcggccaatattcaacattcttaaagaaaagaattttcaacccagaatttcatatccagccaaactaagctttataagtgaaggagaaataaaatcctttacagacaagcaaatgctgagagactttgtcaccaccaggcctgccttacaagaattcctgaaggaagtactaaatatggaaaggaaaaaccagtaccagtgactgcaaaaacataccaaaatgtaaagaccatcgacactataaggaaaccgcatcaactaatgggaaaataaccagttaacatcacaacgacaggatcaaattcacacataacaatattaacttaaaaggtaaatgggctaaacgccccaattaaaagacacagactggcaaattggacaaagagtcaagacccattggtgtgctatattcaggagacccatctcatgtgcaaagacacacataggctcaaaataaagggatggaggaatatttaccaagcaaatggaaagcaaaaaaaagcaggggttgtaatcctagtctctgataaaacagactttaaaccaacaaagatcaaaaaagacaaagaagggcattacataatggtaaagggatcaatgcaacaagaagagctaactatcctaaatatatatgcacccaatacaggagcacccagattcacaaagcaggttcttagaaacctacacagagacttagactcccacacaataataatgggagactttaacaccccactgtcaatattagacagatcaacgagacagaaaattaacaaatatagtcaggacttaaactcagctctggagcaagaggacctaatagacatctacagaactctccaccccaaatcaacagaatatacattcttctcagcaccacatagcacttattgtaaaattgaccacataattggaagtaaaacactcctcagaaaatggtaaagaacagaaatcataacaaacagtctctcagaccacagtgcaatcaaattagaatgcaggattaagaaactcactcaaaaccacacaactacatggaaactgaacaatctgctcctgaatgactagtggataaattatgaaattaaggcggaaataaataggttctttgaaaccaatgagaacaaagacacaacataccagaatctctgggacacagttaacacactgtttagagagaaatttatagcactaaatgcccacagaagaaagagggaaagatctaaaatggacaccctaacattacaattaaaagaactagagaagcaagatcaaacaaattcaaaagctagcagaagacaagaaataactatattagagcagaactgagggagatagagacacgaaaaacccttcaaaaaaaatcaatgaatccaagagctggttttttgaaaagattaacaaaatagaccactagccagacggataaagaagaaaagagagaagaatcaaatagacacagtaaaaaatgataaaagggatatcaccactgatcccacagaaatacaaactaccatcagagaatactataaacacctctacacaaataaactagaaaatctagaagaaatggataaatttctggacatatacaccctcccaatactaatccaggaagaagttgaatccctgaataggccaataacaagttctgaaattaaggcagtaattaatagcctactaaacaaaaaaagtccaggagcagacagattcatagccgaattctaccagaggtacaaagaggagctagtaccattccttctgaaactattccaaataatagaaaaagagggactccttcctaacttattttgtgaggccagcatcatcctgataccaaaacctgtcagaaaccaacaaaaaaaaaaaaagaaaatttcaggccaacatccctaatgaacatcgaagcaaaaatcctcaataaaatactggcaaaccaaatccagcagcacatcaaaaatcttattcagcaccgtcaagttggcttcatccctgggatgcaaggctggttcaacatatgcaaatcagtaaatgtaacccatcacataaacagaaccaacgacaaaaaccacatgattatctcaatagacgcagaaaaggccttcaaaaaaattcaacaccctttcatgctaaaaacacttaataaactaggtattgatggaatgtatctcaaaataataagagctatttatgacaaacgaatagccaatatcatactgaatgggcaaaagctggaagcattcccttgaaaaccggcacaagacaaggatgccttctctcatcactcctattcaacacagtattggaagttctggccagggcaatcaggcaagagaaagaaataaagtgtattcaaataggaagacaggaagtcaaactatctctgtttgcagatgacatgattgtatatttagaaaaccccatcatctcagccccaaaactccttaaactgataagaaacttcagtaaagtctcaggatacaaaatcaatgtgcaaaaatcacaagcattcagcattcctatactccaataatagacagagaatcaaatcatgagcaaactcccattcacaattgctacaaagagaataaagtagctaggaatacaacttacaagggatgtgaaggacctcttcaaggagaactacaaaccactgctcaaggaaatatgagaggacacaatcaaatggaaaaacattccatgcttatggataggaagaatcaatattgtgaaaatggccatactgcccaaagtaatttatagattcaatgctattcccatcaagctaccattgactttcttcacagaattagaaaaaactagtttaaatttcatatggaaccaaaaaagaggccatataaccaagacaatcctaagtgaaaagaacaaagctggaggcatcacgctacctgacttcaaactatactacaaggctacactaaccaaaacagcatggtactggtaccaaaacagatatatagaccaatggaacagaacagagacctcagaaataacatcacacatctacaaccatctgatctttgacaaacctgactaaaacaagaaatggggaaaggattccctatttaataaatggtgtcgagaaaactggctggccatatgcagaaaactgaaactggacctcttccttacaccttatacaaaaattaactcacgatggattaatgacttaaatgtaagaactaaaaccataaaaatcctagaagaaaacctaggcaataccattcaggacataggcatgactaaaacactaaaagtaatggcaacaaaagccaaaattgacaaatgggatctaattagactaaagagcttctgaacagcaaaagaaactatcatcagagtgaacaggcaacatacagaatgggagaaaatttttgccatctatccatctgacaataggctaatatctagaatctaaacagaacttaaacaaatttacaagaaaaaaacaatcccatcaaaaaatgggtgaaggatatgaacagacacttctcaaaagaagatatttatgtggccaccaaacatatgaaaaaaagctcatcatcactggtcattagagaaatgcaaatcaaaagcacaatgagataccatctcacgccagttagaatggcgatcactaaaaagtcaggaaacaacagatgctggagaggatgtggagaaataggcatgcttttacactgttggtgggagtgtaaattaattcaaccactgtggaagacagtgtggcgattcctcaaggatctagaaccagaaataccatttgacccagcaatcccattactgggtatatattgagaagtttataaatctttcttctataaagacacatgcacatgtatgtttattgcagcactatttacaatagcaaagacttggaaccaacccaaatgcccatcaatgatagactagataaagaaaatgtggcacatacacaccatggaatactatgcagccataaaaaagaatgagttcatgtcctttgcagggacatggatgaagctggaaaccagcattctcagcaaactaacacaggaacagaaaaccaaacactgcatgttctcactcataagtgggagttgaacaatgagaacacatggacatagggaggggaatatcacacaccagggcctgtcagggggtcgggggcacggggagggatagcattaggagaaatacctaatgtagatgatgggctgatgggtgcagtaaacccccatggcacatgtatacctatgtaacaaacctgcacgttctgcatatgtatcccagaatgtaaagtataataaaaaaaaatggtcctgggaaaactgtttagccatatatagaaaattgaaactggacccgttccttacaccttatacaaaaattaactcaagatggattaaagacttaaatgtaaaacccgaaactatagaaaccacagaagggctgggtgcagtggctcatacctgtaatcccagcactttgggaggccgaggcaggtggatcatgaggtcaggagctcgagaccatcctggccaacacggtgaaaccccgtctctactaaaaatatgaaaatattagccagctgggcatggtggcacgtgcctgtagtcccagctactcaggaggctgaggcaggagaatcactcgaacctgggaggtggaggttgcagtgagccgagaccacaccattgcactctagcctgggcgatggagcaagactccgtctcaaaaaacaaaacaaaaaacaaacaaaaaaaccccaaaacacacacacacacacacacacacacacacacacacaaaccatagaagacaatataggcaatactattcattcaggacacaggcacgggcaaagacttcatgatgaaaacatcaaaagcaattgcaactaagcaaaaattgacaaatgggatttaattaactaaagagcttctgctcagcaaaagaaactatcatcagagtcaacagacaacctatagaatgggagaaaatttttgcaatctatccatctgacaaaagtccaatatccataatgtacaaggaatttaaacaaattcacaagaaaaaaacaaagaacctcgttaaaaagtcggcaaaggacacgaacagacacttctcaaaagaagacatttatccagccaacaaacataaaaaaagctcagcatcactgatcattggagaaatgctaatcaacacaatgagataccatctcacaccagtcagaatggcgattattaaaaagtcaaggaacaacagatgctggtgaggctgtggagaaacaggaacgcttttttacactgttggtggaaatgtaaattagttcaaccattgtggaagacagtgtggtgattcctcaaagacctagaggcagaaataccatttgacccagcaatcccattactgggtatatacccaaagaatataaatcattctattataaagatatatgcatgtgtatgttcattgcagcactattcacaatagcaaagacatggaatcaacacaaatgctcatctgtgatagactcgataaagaaaatgtggtacatatacatcatggaatgctatgcagccataaaaaggaaagagatcatgtcctttgctgggacatggatggagctggaagccattatcctcagcaaactaacacagggacagaaaaccaaacactgcacgttctcacttgtaagtgggagctgaacaatgagaaacacatggacacagggaggggcacaacacacattgggacgtgtcggggctgggaagggagagcatcaggaaagatagctaatgcatgccaggcttaacacctaggtgatgggttgatagatgcagcaaaccaacatggcacaggtttacctatgtaataaacctgcacatcctacacatatgtactggaacttaaaataatataaaataaaaaatataaaataaaacataccatgcacagttcctggcatacagatggtgaagctataagtaacggatcagaaatataatttaaagatgctgaagaggatattaaaatttgtaattataaatttaatttacatttttgtaggaagaatttttttaaagattttttttcttcttcatcttaattatatgcttttgactaatagaatgttagtaacaatacagattgacaggcaaaatgagaatgcagagtatttggaattttactatttcaaaaagatcaaatcaaagattagcttagtggagtgaatggttgatttgggaaatggttcagaactagttagcgaaaaagtctaagatgatgcattcttagatataagaaaggggaagagatttgaataaatcaacaaaacaaagatgaagcagtttcaatgagggtcgtgaacaaatttaaaaaagagaaaaagaaataaatgttaacatgaggtagttatagatcaattactttaagactaatacatacctctggaactgaagtttccatcagagacagtggaggaggaacacatccaccatcctgtgcaatttccactggttgataaataacctcagaaggttgcaggtataagaatggagcagaagaggcagaaggctaaaatacaaaaccatatttctaattcaaatatgattagttatttctgttaaaccaaatgacttagccaacagatgagagaagtacttgttttttattttactaaatttttttttaggaatagcacagaagtatctcagcaacggattagaaactgatctgttataaattccaactgtgtagatgtagttaaagaatcttatcattggtaagcactagaacttcttaatgactgagaacctcatatataaattcagataataattatggttatattaatgtcaccagtaaaggttgtgataatgtgatctatggtatttaaattgacataaatgtctactctcagctctgtgacttctaatgaaagtgggaaaatgtgaaacttttttggtgaagtactatttgttaccaaaagttgggaaatagaatacttatttaggaacagaataaaaactgaagccaaatccaaatgaagttagaaaaatgctaaattttcaaataacactaatagtaaaaaagggtaagttttcatgtttatacagtacacatttataaaatgctttcacttatgcattatcatttgatattcacaaaaatcatgtaaggaaacttacaaaggtatagtatcattatatccattttacaaatgaagaaactgaaaatgaactgccaaaagaataagttaataaacagaagaagaaggtctcaaatctaaaaaactttagtattcatgcagtcatcacaagaatataatgaaagaaggatttaaaattatatattgaaagttaacatttacctgaggaacactccactgccactgtcctggtaaatactgtgtggtggcctaaaattaaataaaagaaaagaaaaacccattctgattataaacaagggttaaaactagatatctacaggcaaaaatatgaagttggaccctcacaccatatacaaaaattaactcaagccatatacaaaaattaactcaaaatggaccagagacttaaatgtaagagctaaaattatacatctcttagaaaaaaacataggtgtaaatgcctgtgaccttgaattaggaaatgtttttaaaattatggttccaaaagcataaacaacaaagcaacaacaaaaaatagttaaattagatttcatcaaaactttaaaaaacttttgtgcaagtgaaaatacaacccacaggatgagagaaaacatggaacttatatcaagaatgtataaagaactcttacaactcaataatcaaaagacaagtaacccaacttaaaaattggtaaatgatatgaatagacttttctccaaagaagatatacatatggccaataaacacaagaaataatgctcgacaccactagccttcagggaaatacaaatcaaaaccataatacaacatcacttcatacctactaggatggctttaatcaaaaaagtagatcataaatgttgacgggcacgtggagaaattagaaccctcataatctgctggtgggaatgtaaaatggcgcagccctttgggaaaataaacacttccttaaaaggttaaacaaagttaccgtatgacccagcaattccactctagttataaaacctaagagaaataaaaatatgtgttcacataaaaatttgtatgtgaatgtccatcgcagtatcatttataacagtcaaaaagtagaaacaactcaagtgtccatcatctgatgaatggataaacagaatgtggtacagtgtatccatacaatgggatattatttgagaacgaagtactgagatatgtcatgtctcatttatcatgacatagataaatcttgaaatcattatgctaaatgaaagaagcctgtcacaaaagaccacatattgtatgattgtttttataggatatatccagaataggcaaatctagaaaaacaggtaagtagattactggttgcctagcactgggataaggggaaaaagaagactcaactcatctactgtagcacaaaaacagccatagacaataagtaaacaaatgtggctgtgttccaataatgttttatttacaaaaacaggctgctggctggagtttggtctgcaagccatagtttgatgaccctgctatagaccagaatgatctggcattatagttcacttatccccaatttctcactaaaattaatgaagagtgctggttaactgaaagaggatatcataatatataataaaccacaatatattatttgctttaatataaattatgttaaatataatatagcaagaaactgacatatgttaacattaaaaaaccagcttgcagtccaatacctgtatcttacttggggaattattgctaaagactttttagatctaaatgttagccaggggagcaaaactgacctcatcacatttggtaaaaggaagcaaagagtccatccatcttcttgtatgacattgtttaattccctcgtaaaaaaagagaggcatgatgtcagcaagatggctgaccagagatgcctagcattcattttccactggctccccaccccgccacaagaaaagactaaggcaaagaataaacagctacaatttgacaggagcatcaaaaggagagtgctggagtgccgcaggggagtggagacacacctgtggtgattgcaaatccaggagcgcagcatggagccacccagcctctgcaaacccttctcttctgctaggattggttctgcctggagtcctgcagtttcttattgcagggaaaaggtaagcagaagatccccaccagcctgcattgctactgcaaacagccacactccttgcaacaggagaatcccacagtctcacagtttgaagagctgctgggaattcgtggctgcattgccccgaattaggagtacaaagtgtgtactccccaccccctcaaccccaccctgtgagcgaagctgctacagcgtgacagcatcttgaagccatagtcatctctagggggccagtagctattgcacgtctccagtactggggttccattttcattctgccaagtacacaccagtggctgaacacaacctcagcagcatggaacctgaggctcaagattggctgtgattctggttctgtacagtagggaaaccaacgtctgttgccctcacctccagctagaggaacaatctggctgacctgcccagggtgaacccactctttagctggtcaaactgctgcactctcctgagcaggacaggtcctcaagcctcgtagtagctgacatgctgccgggatggaatggttacacacctgcatacagggctgagaaacagcccagaggtgcctcacgccctgcagacaagcccctgacctaccctgtgcatgcaattagagcccaagaaacagctccggggactgccactggcagaaatgtccccaggggagtggagtggctgtgtgtccatgcctcaggcctaagaaatggcctcgtgcccacccctccagcagacacgtccccaggacagctgagcagcctggagcctgtgtcccaggcctgaaaagcagccccataggctgcttccagtgggcatgatcccaggccgaccaatagccctgtgcctgcattctgggcctatgaaacagccctcacagaaacgtttccaggccgggtgatccaccctgtgcctatgtcccagacttgagaaatagctccgtgggccacccccagcagacatgcccctaggccaggtgagcagttgtgcacctgcatcctgagccggagaaacagcccctgacaaacatgtccctagccgactgaacagccatgcagctgtattccaggcctgagaaacagtcccatgggctgtccccagcagatgcacccccaggccagcgaaggagccatgtgcctgcataccagacctgagaaacagccccacaggctgcctctggtgggcactcctccaggctggctgagaaactgcatgcctgtgctctcagccagagtaacagccctgtggccccaagcccagtgagccagacttaccatgttcatgtacacagccctgacctgaggaacagctcagcaagcccacccctggcaaagccctaccaccattgtcatagactctcttttgctaggtcactgagaaacttggaaacacaactagagagtattacagcttaagagactaaacagagactaccctagcagataggttgaatctagcagattcaatctaaacagatcctctcagaggcacattatagtcaaattgttaaaagtcaaagagaaagaaagaattttaaaagcagcaagaaaaaagtatcaagtcacaattaaaggaatccccattatactaacagcagatttcttagcagaaatcttaccagggagaatgggatgatatatttagatatattcaaaatattgaaggaaaaaaacctgccagccaagaatattatacccagtaaagctatccttcagaaatgaaggagaaatacgatctttcacaaggccaggtgtggtggctcatacttgtaatcccagtgctttgggagactaaggcaggaagattgcctgagcccaggaatttgagaccagcctgggcaacatagcaagaccctatctcttaaaaaaaattagcaggcagggcacatgcctgtagtctcagctgtgtggcaggctaaggtgggagggattacttgagctcacgagtttgacactgcagtgagctatgatcatgtcactatactctgtctctaaaaaaaccagctctttcatagacaagcaaaaactgagagaatttatcaccactagattggccttacaaaaaaaatactcaagggagtctcacatcaggaagtgaaaggatggtaacaacgatcatgaaacatgcaaaactataaaattcactgggacagccattacacaaaggacaaaaagaagaaaagaatcaagccttataattacagagaacccagctgcaaaaaatcaccaaaaagagagggaacaatgaacaaaagatatgcaaaataaccagaaaatgataaataaaatgacaggatgtcctcacctatcaataataaccctgaatgcaaatgggttaaattctccatttaaaagatagagactagctgaatatattaaaaaaagagacccaactatatgctacctaaaagaaactcaccttacctgtaaagacacacataggctgaaagtgaagggatggaaagacatgtttcatgcaaatggaaaccaaagcaggcaagagtagctatacttatatcagacaaaaccaacttcaagttaaaagttttaaaaagagacaaagaaggacatttatataataatatagggatcaattccgcaagagaatataacaatgtaatacatatgtacccaacaaaaagcacccagatatataaagcaagtcttatttgatctaaagagagagggagaaaccccaataaaatagtggttggggacttcaacaccccactctcagcattggacagattatctagaaagaaaataaacaggccgggcacagtggctcacacctgtagtgccagcactttgggaggccgaggtgggcagatcacaaggtcaggagttcgagaccggcctgaccaatatggtgaaaccccgtctctactaaaaatacaaaaattggccaggcgtggtggcatgcaactgtaatcccagctaccgaggaggctgaggcaggagaattgcttgaacctgggaggcggaggttgcagtgagccgagatcatgccattgcactttagcctgggtgacagagcgagattccttctcaaaaagaaaaaaagaaaagaaacaaagaaacatggatttaaactgcaccataggccaaacagacctaacagccatttagagaacatttaactgaacagctgcagaatatactttcttttcatcaggatataaaacattctccagaattaccatatttcaggaaacaaaacaagtctcaaaaaattaaaaaaaactgaaattatataaagtatcttatctgaccacaatggaataaaacaagatatcaataacaagaaaaacattcaaaactatacaaattcatggaaattaagcaacatactgctgaatgaccagtgggtgaaggaagaaattaagaatgaaaatagaaacacagcataccaaaacctatgggacacaacagtagcagtattaagaggcaaatttataacaatgaatgcttacatcaaaaaactagaaatatttcaaataaacacccttacaatgtacctctaggaactagaagagcaagaacaagctaaacccaaaattagtagaagaaaagaaatagtaataatcagggcagaaataaacaatgttgagactacaaaacaatacaaaagattaacaaaacaaaaggttgactttttaaaaagataaaatcgacaaaccattagctagtctaagaaaaaaaagaaagtagacccaaataaataaaatcagcaatgaaaaagacaccacaatgaataccacagaaatacaaaggatcattagaggctaatatgaacaactctatgcaaataaattaggaaacctagaagaaacggataaattcctgaacatatacaatctgccaagactaaaccaagactgaagaaattgaaaaccttaagaaacaaggccgggcacggtggctgacgcctgtaatcccagcactttgggaggccgaggcgggcagatcacgaggtcaggagatcgagaccatcctggctaacagggtgaaaccccgtctctactaaaaatacaaaaaattagccgggtgtagtggcgggcgcctgtagtcccagctactcggaaggctgaggcaggagaatgacatgaacctgggaggcggagcttgcagcgagcagagattgcaccactgcacactccagcctgggcgacagagagtccgtcttaaaaaaaaaaaaaaaaaagaaagaaaaccttaagaaacaaatttaagtaacaagattgaatcagtaattaaaacgtcttccaacaaagaaaagtccagaactacatggctgaattctaccaaacctttagagaagaataccagatcttcccaaactattccaaaaaattgaagcagagggaattctccctaattcatcccattagtttgattatattaaactaaaaagttcctgcacagtgaataaaacaatcaacagagtgaacagacgacctgttgaatgggagaaaacatctgtaaactacttatctgacacagaattaatacccaaaatttacaaggaactgagacatctcaacagcaaaataaacaaaaaataaactgattaaaaatgggcaaatgatctgaatagacatttctcaaaagaagacaaagaaatggctaacaaatacatgaaaaaatgatcaacatcactaattatcaggaaactgtaaatcaaaaccacaatgaggtattatctaccccagttaggatgtttattgtcaaaaagagaaaataacaaaccctggtgaggatgtagagaaaagggaactcttatacactgttactaggaatgcaaactagtacaaccactatggaaaacagtatggagatccctgaagaaactacaaatagaactaccatatgatctggtaatcccactactgggaatttatttggagaaaaggaaatcattgtatcagagagacatctgcacccccatgtttattacagcattattcacaatagccaaaatatgaaatcaacctgggtgtccaacaacagatgaataaagaaaatatggtatatatatacacaatggaatactatttggctataaaaaagaataaaatcctatcactcatggcaacatggatggaactggaggtcattacgttaaatgaaataagccaggaacagaaagttaaacaacacatgttctcactcatatatggaagctaaaaaacactgatctcaaaaatctgccacctgcacagatatttttgaaagaaacaagttttatttttccccctttcttgtaataagtgataaaattccaagtctttttcactgccttccaaaccatgttcagaagagagtagcttatcctctgctggtctacactggttgctgaatttacttgtattcctgtttttgtatatgctgcatttagacttacatatggcaagaaggcatttttgttgttgttgttgttaaaggaaacaaactctcaaatcatgaagtgatgtaaatgttgcatatgcctacaaagctctgaattcaggtcccattgctgtcacaaagaaatgaatgtaactcctaccctaatcccttttttatataataaaactgccttagcatgagttgcaactgtcatcactacagtaagctggtttacagatgttttccactgagcatcacaataaagagtaccatgtgttacaaaaaaaaaaagttgatctcatagaagtaaaaagaatactaggggctgagaaggatagagggaaaggaggaatagggagaggtttgtgaaaggatacaaaattacagctacctcaggaatggaaaaccaaacatcctatgttctcactcataagtgggagctaagctatgagtatgcaaaggcataagaatgatacaatggactttggagacttagggagaaggagtaggaagagggtgagggataaaagactacaaattgtgttcactgtatactgctcgggtgatgggtgcatcaaaatctcacaaatcaccattaaagaacttactcatgtaaccaaataccatctgttccccacaaacctatggaaataaaaattaaaaaaaaaacaacaaaaaatccaaaacacctccaaaattacagctagataggaggaataagttctaatgttttataccactataggatgactatagttaacaataatacatagtttcaaatagctaggaggctattgaatgctcccaacacaaagaaatgataaatgtttgagatgatggatatgctaattactctgatttgatcaccatattacatgtatcaaaacatcactacataccccatgaataggtataattatcatttgtcaatgaaaaaaaattaaaaaaaaaacactaccaaggattaactatctcttttttattttttattttctaactaatcatttattttattttacttatttttaaaacttttattttaggttcaggggtacatgtgaaggtttgttacataggtaaactcgtgtcacaggaggttgttacacaaattatttcatagcccagtacccaatagttatcttttctgctcttctccctcttcccaccctccaccctcaagtagaccccagtgtctactgttcccttctttacgttcatgagttctcatcatttagctcacacttataagtaagaacatgtggttatttggttttctgttcctgtgtcagtttgctaaggataatggcctctggctccatccatgtccctgcaaaatatatgatctcattgttttttatggctgcataatattccttggtgtatatgtaccacattttctttatccatctgtcattgataggcattccatgtctttgctattgtgaatagtgctgcaatgaacattcgcatgcatgtgtctttatggtagaatgatttatattcctctggctatatacccagtaacgggtctaatggtagttctgcttttagttctttgaggaatctccatactgctttccacaatggttgaactaatttacactccaaccaacagtgtataagtgttcctattctctgtaacctcgccagcatctgctatttttgactttttaataatagccattctgactggtgtgagatggtatatcaatgtggttttgattcacatttctctaatgaactatctctttgtaattagcaaagtagttgcatgagaaagaaataaatgaaagttagctaagaaaggactgaaagtttcagagagaattttaattgtaatttatgtttacctggtagtgatatgcaggttgctgataaatgggctgagctaccatcacaggggagctacatacagaacgtgactataaaaggatggaaaaagaaaaattaggcagaagcctttaaaatagctcacaataaaatttatctcaaattattacctaaacccagtaaacttctggtttatgattagaaatattatttttctacctcttattgatatgattaccaactctactaagtctattaaaatcatcacaatatttctacttctacgtggtttcatttccatagtaatgctaaaacaatcaccagaaaagttgtttttagtctgaaatgtaccatctccaaagattatgaaaatatagttataagagaatacttagaggaaaatgacagcaagacttagggtgacgctgcctgtttccattgtggggaccagcaggaaacagttaatgtttataatagtgtttagaactgaatgaatagtcgtatctaattttcccactagttacaaataatcaatgttctattcctttgttatacctataattaaagcaaagatattttatttttattttagtaatttgacatttaaaagagttaatagtttgataaacttacaagtgaaaaatctgtgctgaaaaaagtacaggtaacacttgattattcaaagtgaaagagtaagccccaaaacagattacttaaaaccagatctttaataaaacaggcaagttgtattgcaagatagtaaaactggctctaatgtagcaattaaaattcagtgtctaatgtgggatctaacttatattgttttgtttaatgtttgcacccccgaaactgaggaaaagtatcacagttttgtacaattcacagactatggtatgctaataaaactgtatcactgattaacattagaaaataataatgtaatttcccatattaatagattaaaggagaaaaaatggtaatttcaacagagacagaaaatgcatttgttaaaattccatacctttttatgattaaaaactcttaacaaacatggtagaaaatggcttccttaattgatttagggcagtaactctcaaccatgagtgattttgtcctatagggaacatctggcaatgttgggagacatttttgattatcataactatggggagcctagggatacttctaaacatcctacagtgcacaggacagaccttcacagcaaagaaataatctggctcaaaatgtcaacagtgctaagattgagaaagtctggttaagagtatcttcccacttacaaagtatgcgtgtgtgtgtctatatatgtatgtatacatgcatgcatacatgtaaagtttaatggtgaatcactgaaattgctccctttttcaagaacaaggtcatgatgttttcactacatcaatactgtagcagagacatggtcagtgcaaaaactccaggaaaaaaagaagtgaaagaaatagaagtacactgaatcataaataattgtgtaaatgagagtttggcagggttactgatagattatcactattgaaaaatcaagagcattactatacaccagctacaatctattaggaaatgttatttaaaaaacagcattcattaaagcaacaaaactatagtctactaagaataaatttgacaaaatgtgtcacgcttttttatggagaaagaaaacttttttatggatagaagtaaaataagacaaataaatggagagatgtatcatgttcatggataggaagattcaatattttaaaatactgaaatgtcccaagttattcacactatttaatgcaattctaataaaaaaaagggcttttcactgaactaaacaaactgaattaaaaaatttatacacataaaagcaaagacataaggatagatgagagactcctgaagatgaacaatgtactttaagatttcaagactcgttataaagtcaaaataattacaactgggcaaggtgaacaaatacaccaatggaacaaaatagcagaaaaaagacccacacacatggaaacttagtgtttggcagaggattaatttcaaaatagcaggaaataggtggattagtcgatacataaattcaagatttaagatctagaagtgaaaagtggcaatactatagcattaaaaataaaaaatagcatatattcttgtagtaaaaaacaaaaaactaaaaaagaagaaaaaatcttgtgccagttttcaaagggaatacttccagtttttgcccatctagtatgatactgactgtgggtttatcataaatagctcttattattttgagatacgttccatcaatacctagtttattgagagtttttagcatgaagggctgttgaattttgtcgaaggcctttcctgcatctattgagattaatcatgtggtttttgtcgttgggtctgtttatgtgatggattatgtttattgattcgtgatgttgaaccagccttgcatcccagggatgaagccaacttgattatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttagggaggattctctctttatctattgattgaaatagcttcagaaggaatggtaccagctcctctttgtacctctggtaaaattcggctgtgaatctgtctggtcctggaatttttttatttggtagtctattaatgattgcctcaatttcagagcctgttattggcctattcagagattcaacttcttcctggtttagtcttgggagggtgtatgtgtccaggaatttatccatttcttctagattttctagtttattggcgtagagccctctctcttcactcctattcaacacagtgttgaaagttctggccagggcaatcaggcaggagaaagaaataaagggtattcaattaggaaaagaggaagtcaaattgtccctctttgcagatgacatgattgtatatttagaaaaccccatcatctcagcccaaaatctccttaagctgataagcaacttcagcaaagtctcaggatacaaaatcgatgtgcaaaaatcacaagcattcctatacacaataacagacaaacagagagccaaaccatgggtgaacgcccattcacaattgcttcaaagagaataaaatacctaggaatccaacttacaagggatgtgaaggacctcttcaaggagaactacaaaccactgctcaacgaaataaaagaggacacaaacaaatgggagaacattccgtgctcatggataggaagaatcaatattgtgaaaatggccatactgcccaaggtaatttatagattcaatgccatccccatcaagctaccaatgactttcttcacagaattggaagaaactactttaaagttcatatggaaccaaaaaagagcccacattgccaagacaatcttaagcaaaaagaacaaagctggaggcatcacgctagctgacttcaaactatactacaaggctacagtaaccaaaacagcatagtactggtaccaaaacagagatatagaccaacagaacagaggcctcagaaataacactacacatctacaaccatctgatatttgacaaacctgacaaaaacaagaaatggggaaaggattccctatttaataaatggtgctaggaaaactggctagccatatgtagaaagctgaaactggatcccttccttacaccttatacaaaaattaattcaagatagattaaagacttcaaatgttagacccaaaaccataaaaaccctaggagaaaacctaggcaataccattcaggatataggcatgggcaaggacttcatgtctaaaacaccaaaagccatggccacaaatccaaaattgacaaatgggatctaattaaactaaagagcttctgcacagcaaaagaaactgccatcagagtgaacaggcaacctacagaatgggagaaaatttttgcaatctacccatctgacaaagggctaatatccagaatctactaagaacttaaacaaacttacaagaaaaaaatcaaacaaccccatcaaaaagtgggtgaaggatattaacagacacttcttaaaagaagacatttatgcagccaaaagacacatgaaaaaatgctcatcatcactggccatcagagaaatgcaaatcaaaaccacagtgagataccatctcacatcagttagaatggcgatcattaaaaagtcaggaaacaacaggtgctggaggggatatggagaaataggagcacttttacactgttggtgggagtgtaaactagttcaaccattgtggaagtcagtgtggcgatttctcaaggatctagaactagaaataccatttgacccagccatcccattactgggtatatacccataggattataaatcatgctgctataaagaaacatgtaaacgtatgtttactgcggcactattcacaatagcaaagacttggaaccaacccaaatgcccatcaatgatagagtggattaagaaaatgtggcacatatacacaatggaatactatgcagccataaaaaggatgagttcgtgtgctttgcagggatatggatgaagctggaaaccatcattctgagcaagctattgcaaggacagaaaaccaaacaccatatggtctcactcataggtgggaattgaacaatgagaacacttggacagaggatggggaccatcacacaccagggcctgttgtggggtggggggaggggggagggatagcattaggagatgtacctaatgtaaatgacgagttaacaggtacagcacaccaacatggcacatgtatacatatgtaacaaacctgcacgttgtgcacatgtaccctagaacttaaagtatataaaaaaaagaaatgcaaaaaataaaaaataaaaaccactaaagcagtactatatgtcatttatgaatacatatatttgtagtaaaaatatataaaatgaataggaaagatattctgcttacttttgaacaggaaagagggtaaggaagtgggggtaaggagaattgacctgaagctgtcttactttactccccattttaagaacttaagtaaatgtggcaaaatgttgatgtctatttaatttggttgatgtgtgttattatttgtaattatctgtggttaagatatttcagaaatataacaaacattaaaaaattgatagtaatagatggaaatccttttttaaatgaaattacttacaggccaaggcggtgggaccgaagttacctctggagtatgaaaataagcaacaccattatggtaagtataaggatatccagttgaagttgttagatacattgttccagctgctggcattatactagaacctaaagcaaagattaaataataataattgaaatgttcaatttaactgttaaaaatgtagtttctaaacacttcagaaaaatatttatcttaatatacctatgtagctatggtaaaaattgaatgtcacagatatttttaaaaaattccttatgtcaaagtatctttgaagcctgtatttttaaactcaataccttaaagcttttagtttaagatgattaaaagaaaagaaaaacaatacgaataagaaataccaaaaatgtatcaattcagattccaacaccagtatgctacacaaagctgaacaatttagactatcatcagcgaagtaattatttgtacaaatataaattatgtataatttaaagttacttcaagacaacatacactgtagtgaagttcctaaggtcttggctagaccttttatttctgaaagtccaaagatgatggaggcagtaaagttggagaagattctactttcctgaagacattttggttccaccctactaattctttggatatcctaccagcaaacattcgttcatgctatggctgtcttttatctctcttttctatgatctattctctatctagtctccctttgctacaactgctgctgttgcaaacatgaccgcaagtcttcatgtggctagtctggggtccccaactcttttcccgggccaagttatataaacccccaccacaaaccaaaaaacagtaaataatatacatagatatatatatattttttgtcattgaggagactttaaaagttaaattagccaaattagattaggtcttaaccagcaaggttatataaattagtgaaactgacaattcttccacctataccagtgcttctcaaaatttcccataaattagaatcacttaaattgttttctaaaatgcaaattccagggacttatcttcagagattttgagtcagtaaatctgggacagggcctaagaatttgcattttgacagcttccaatgaaatgacactgtctgcaaaccacacttcaaatagcatgggcctaccactttaaataatactattgctcctcagcttttatattttcactgcatttgatctagtattgttattatttattttaatggttcttaattagatccttttgagaatttgatgaaaatcagggaccttttcctcagatatatatacagtcaaacacaattttacacacaattttggaggtccatggattccccccaaaagatattccactattattcaaagataatgataatggttcattattcaataatggttcattattcaaagaaaatgaaccatgctttacctgctaaataaataaattttcagtgcatactatttcaaggcattgaacagggccctagtgatacagcaaaaaataaaaaaattagacatgagatggtctgtatcctcaaagaagttaggtctggtagtgaagatagtcattagttgattacacaattaattaattaaatacaattttgataaatacatgaggcattatagggtacgatactgaacatttcaattattatgtatacaaaacatatataaaatttctctctatatacatatatatggaaaatttgtgatgaaatgatgttcagctaagctctaaagaatgaattggatggcaaagtacattctaggtaaagaaaacagtatattagattctgagaacaggagtatagaatgttctggaactgaaagaaggctacatggctaaagcatggaaagaaaagggaagaatacctcaaaataagctgagcataagacaataagaggtgcacttttgaaagatcactctggctgccttgtgaatgatggattggaaggtagaaagattggattcagagagaccacttaggatgtttttccaggaattaaggtaaacaaagtggttagttgggactcgggtgttggtaatggagatggaaagaaatgacagatctaagaaaaaactaagataagaatcccttatttgtaaatgtacttttaacacctatttttcttcgcagaaaagtcaaaagaactttggagtcaaacagtcctgcatttgaaggctagtgctaccactcaccattaggctatttaaccccatacttcttaaagttggataagggatggatggtataccaggagatatgaaaaagcagaggctgaacatagtaatcttcctacagaatcagttttattcaattgtttttgggaaatatttttatattcaaataaacaatatgatattatggaacagaatgcaaattatacatgatgtttttgcataaatcatgagactttaaagaaaatttgcaattccagtatgctgcagtgggttaggaaccacaacatgccaagattaactctcctctacctttaggagtatttcagcagaaacatttttaaaacaatgactttatctttttgggattgaattttctatttacaaaaatagagataacaatacatcatgggattctatgaagattaaatgaaaactcataacattgacccttgcactaagtagttttgaaaaaactatttgtatatgtgaaagcattcagcatagtgctgatttattttctatttcagcaactggtagatcatactatgagcattactatttagtacatattgctggtgataatgggctaacggaccgttactatatgttctagcttaacctttgcaagtaacaacagtagattgaaaatattcagcattctgccatatttagtgcattccattttgtattaacctactgaggatactttgattgtctcctaaattaacaaatactaagtcaaaattaaacttaatatacatcaatctcttttttgttgtagttgtggcaactgtattaaccaaatatctattatttctaagtcaaaagcataacagtccaaatgaatacaatctattaatttgttaacagattatatataataacctaatgttttaaacattcccgtagacactaggatgtggctaagggaaaataagttagttataaattttacatcacatttctccttctagccaaagactgttaggaattttaataaatattaaaggtaaaaagttaactataaagatgcctaacttaataagtagaaagagtgaggaaagatagaattgaaagcattagagaaatttgaggaaggtagatacataatttagccaattcctaaagctttagggattgtccccctgaaaattatgacacacctggctgggttacagtacacagcatgcagcgagtttctgatattagttctatgttttcactttcaatatttttactctgattaattttaaattagtttctaattaaaatttttctcattagtaagtctaaattattaaattacttctaattacttttgctatattaaatgatattttcatcacgaaagattttttttcctttaatgatgtaactacatggaatatacttaagcatctttatgtatataaattttttcccagccaaaaaaattgagatatattattttgtggcaaaaatattcagtttttccaccaactttgctaaaataactttattagatgaaagaaacatgatcttttaataaagttctataaaaagtcttatatttcaaaaaagaaccatgcaaaaatatttaaaaatacattagttctcaatacatacgagggatccctacttgttgttttcttattgctggaccaatgttcagcttcttatccttataattaagtttttcagcctaaaataaagaaaaaagaaattattttattattttagcactattatttataaaatcaataaggaaaaactagttagaaagaatttcaaaaattcagactataatattctttcaaagcagcaaggaatagtgggaaagagccgtcttcagactgaaatagatctgggtctgaccgcaattccccattttctccatttgtaatacagtcaatcctcattactcatggattctgtatttgtgaatttgcctacttgctaaaatttacttgtaatcctaaaattaatatttgtggcaattttgaggttattagtggacacgtgaagagcggcggaaaatttgagtagcctgatgcgcatgctcccagttgaggtcaaataaggcgatattctttcttcttgttccagtgctcatactctaagagagagctttctatttagtgccatgttttctccatttttgtgctttttgttggtgatttggctatttaaaatggcccccatgtgtattgttgaagtgctggctagcacaagaagactgtcataggcattatggagaatatatatattagatgtgcttaattcaagcatgaattatagtgctattggccatggcttcaatgttaatgaaccagtaatctgttatatatgatgcctttaaatggaaaaccatataaaacaaggttatatattgataggttgatggcaatattgtgaccagaggttcttgggaacattaccttgtacttcccctagaaagaggagttcagcatttgctaattcagtgttcctagcaatgttagagaacataactgccacaaataacaagaattgactgtatttgattttaataacatacaattcaaattctactttttttctaaaaaagttaaatgttatatttgccttaacttaaagttattacactgaattgctggctataggctttttttctgtgaatattcttagtttatataatgtttttcacaggagggaaatcatctcagataacctcactgttggaatccacatttgtagtgttttttaaacattcaaaatgctattaacacttcgcaaaagatatatccccaagttcttaatttaagtaaataaagcgaaacattatattacagtttcacaaccatacttgtagtgattttggaatttgctcttctgcagattaagtttcctagagaccaatgccaatcttaagatgcaaaccttttttaaaaagcagttgattattgtatttgaaccccgaaaagattagtttcaaatacaaaatttccagaaatgaagttaaatacaccaaaagatcatacctcttgtaaaattttttgtgcatcttcttgtgtttcaaaagtgacgaaaccatacctaaataaatgcattaattattactaattaatcattttcttagaatgttatattaattatattaaaatgtttaaaaattttgtttttaaatcatcggccactgtaggagtaggcatgtttctatgctgcactagcatgggaatcttagaagaatcattcacagcctaacactgtcacttttagtcaggaactaaaagaaaaaaaacccctgagatcttgaaacagcttcagctctcagctgtatgcaggaaagaaaagcacaagagattcatgctgttgcttaaaaattggggatgcaataaatttcaatccagagcaataatctccttttaaactaatagaagtttggctaagagaaatcaaagtagaaaaataactaaaaaatttaaaatttcaacacaataaaatttcttatattggtgaatgacaatgtaaatgtattatttaattattattattagcacatataactgataatgtaattattagtatattcccaaacaatatcaattaaaaatatgtacaacccagatttcacatctgtttttcatacataattaacttcaagcacaattcatataatgttgaagatacaaatacacataaatgatgtgctccatgtccaaaaagccacaataggtagagaaaaaagtaacaaaagaaagaaaaaatgtatctctcaaaacataattgctatttagataacttaagtaaactcttctgagtaatgctaaatatcttcactattttcttcaattcataattactggatcatatacaaagtttcttcttttaaacaaaggaatttctctttatctatttgcccaaacattaaaaagttaaggaattagttttacgctatttttttggtagaacacacacgccacccagtggaaaaggcataaaatacagtttacatttacatttccatgtatgttttccaatgattaaaaaatggtattaccaaaacatagcaaattctgttagtcaaacaaaagaggtaaatctcacttcaccttaatattgtttggcattctgaggaagtatctcatctgtttataaataacctttctgtagaatcccatctcttccagcatatccatctgtcgaatgttgtttctcaccaataccacctcaatgggtcccttttcttatgcctataaatatgtatgtctcgtctctctttcaagaaagtaaatacaatactttactgccttatctattttcttttaactttgcagtccaactccttaagtgagtgtactatgtaaactatctttttcctttctgaaatttggctttgtacacatagcattccactgaaacagctctatacacatttaaagacacagtctattactttcttctcaattttcattatcattgatatagcaattaaaaatcattctcactagaattatatttctcatactggtcccctaattaggtctctgaggcacaacctacagacatttcttggtgtcagctgttttcaaataaagctctctatggcctaaagcagggatacaattccaaaagaatctgattccttttgcttctcattcctcagctaatgtacatctgctacttacattaagtgcttgctgcctaccactgaatggtccctccacccatgcaagaataacttctcaacaaattaagaaatattacagtgtctcctccctccaaaatacacacacacacacacacacacacacaaggaaatcaaaaggtaggaggaaagaagagggcatgatggtctctgctggaaaatggaaccaaagtaaactggcgtacaaaacctagtcatccaatgaaaatagagttgctaattccatagacaatctatagtgatactaaccctttggatactccagctctgtcatttacaatcttcacttctttcacagacccatactgggaaaaaaattttcttaaatcactttcgtttgtctaatggcataaaaagaaaacgttaaaaagcatttttagttgataaaagatgaataattctcatgcttgctctggagacagaaaaagttatagataagatgcatgaaaaatgcctctcatcatcaaaacagtgcataaaccactaggtgattaaaatcaaggtaaatatcttgctttatgcaatagctatgttgttaaattaccatatgccaataaaaatgtaagctgaattattttaaaactacaaaactcactatttaaagaaatctttaaatgattcttgttctctagctggccagtttttaaaaagccaatttggattaggaatgctatttccatagtaagggtacaatactattttggctcttgtggctcagagacagtcatggcagtggaactaggttgtgttggcctacaccagtcattctattttaatcagtagtctcaggaactcctttcctaagtcagttttaggaaaggaatgtatttccaaaagtgcttgaactcaactgtgagaacaatggagtgactataagatttaaagttattagattccttatctgtactcaatatacatttcagctaaattcagacattgttttgataataaaataaaaattggaatcataattagatttaaagcatacaaggtgtctacaaagatggttttggcatgtctgtttttttaattgaaatagtctgataatagactcatatcaccttttctcagaatactgacactaaattcattgcaatttcatttcctggtttagctgtaactgtttgtctacaagagtaacttttctctagaaaaaaatttctttatatacactgcaaaaagacatgccttagtgcagagctatgccttttgagttcaactgccacctcactacttacatacactattggtttttagttggtaacataaagcctgctaagctgcataatgacaaatactgattcaatctaagaaaaactgaatgacttttatttcagttaacagaaaatgaaatcaatgctagaataagaattgttactagatatttgaatacaaattaattccaactattctctggtagaataatcactacctcaattttgtagctccacttctttagtgacaaagagacagtcaagaaaagtaagcattaagagggatagtctgtttgcttataaaaatgaaaggttaaaaagtctgtgactacttgctattaaagtaaatgatttccttgctggcctttatctgtggttttgaaaaaggtataagtatacaggaggaagccctagcaattaccttaaagctatggctgcattataacaaccgtctccaaagtgcatgctgtagctgatgggcttcagtaacctaaaataacctggccatacaaatgtttatatttattgataacttatttttaaaaacatgctaatctattgtaatataaatgaattcccaaattgaacatttctgccagctatcagtattttccacaaagaaaatctttttaaaaataaatattttataagaaataatttttcttactttatttttagtgaaacaatcatatacttgtttaagactcattgttttggcaaatacactaagtgtaacatttctcttgtgcaggaaaaaagaaattccacccaaattgtaacagattggttatatggaaatagttataaatgtcaaatatcacacctaatggcataaggaaggttttttttttgttgaaaatgataactctccctataatttctaatatgtaaaatagaagcttggaaatccttctatatatccatttgaaagtaagagtattccacttaaaatatctatgcatgcctttcttgtaggtgtttactcttacctcccctatgtgggctggggggcactgcacatcatgtcatgaactatgctttcttgaaacagtggaatggctgattacatgatataaatatattagtttttaaaaaacttttattttaagttcggggtacacgtgcagatttgttataaactcatcattggggtttgttgtatagattattttggcacccaggtactaagcctagtaccgaatagttatttttttttctgcttaaatatactacttttaagatgctttattctgacaaggacacaggacttttttggtgatcaaatcctaaattctaacatagaaagtgctttgcaaagaatagatgcctaggaggttgctcaggaatctgagataagagttggggtaaagaaatagtatttcataaaagtaagtttttaaaaaatagagtctcttttgaaaattataataatcaattattttggctattggaatattaggcaagaaagtataattagttctggtatggaagagtatggagctatgagacagaaaactaggcttctagtctcactctgtcactatgtggctagcagcccacagcaagtcagtgaggatcaatttctttatatctgacattgaacagtttttaatgctttatgtaacctacatgctggttgaaaagattctttataataagataattcaaaatctgttaatcattatgcaaatatgttattttatagttgcacaaagaaataatttctgagaaataaagacttctaatgaaaaaatacactttactgcatgcataaataggtaccttaaaatcaattcctcctacaaagatgcgattagggatcactgttccatatcttggggcacttgttgggttattcaaaggcacaggtgacacaggattaggggatggagataatgaatctgtttgcatctggtttgatgtttgctgtaaaataaaattcttttacactttttgcactgggtataatgcagtctgcttttgatgcagaccaaaaacatatatttttcaaaaagaagagtcatttaggcaaaatatagtattctaggctttacttttaatattataaaaattataattagagctaagagctttttaaggcaacagaactaggaaacacagaatctactccactatagagattttaaatattaaatatattacttaaaatgcttatattattatcaaacctattacttaattattaaggggaatattaaactcatgaacatgtttgagaaagagaaaacagtcccagcctgacacaatcaactacaccctggtgttgttaggagttggcctggcactcacagctaggctgtggtgttctcttgttaacagaacaccaacatcagacaaagtcaccctgtgactctgatggatcaagattaaaaacaagaccactccataatcatgtttgaatgctgacaaaaacaaaggcattgcccaaaccacaagaataaccaaacaaccctccattctggctgatatgagtgactgctccttctttatcagctatagttttagcctcgatccatttttctttccttttagataaaagttaacacatccaatcatagaattactaccatttcctgacgctatacattccagagtaaagccctacttccttaaaccctctctagaaattgctcaacagaagcctatatcctgtaagttctaacaccttctgattgagaggccccatggtttatgttttcccttgtttgaacaattaacagacccaactttactaaatgacgcatgtgttcctggtggtctttaactaatggtcatcgacaagttaataaactctaacattcacattcaccattttcagcctgaaagtcaaaattttaaatgcacttgtcaatttgaagattggactgattttgttaaaaaattatatacttgtagctcataaatgtttattccaaagaattagctcagtacatatccacatgttcacaattctaagttagaggacataatttaaattttaataaatatatataaatgtataagcctttgcagaatggtaagataatagacttttaaggtataactgaaaaaaaacccaagacttgagaatcacattgaagagaaaccaattcaagaactggtgaattattttccatctggaaacactaaacacacttctgagacaaaccccataatatcctaaagacaaaccccataatatcctaaatgtgtgcttcaaaaaacttgaagtaaactgggtgttgtggcttgtgcctgtaatcccagctgcttgggaggctgaggcaggaggattgcttgagatcaggagttcgagaccagcctgggcaacaaagaaagaccccatctcaaaaagaaagaaaaagaaaataacaaaagcttgaagttcataattccaattctctgagaaacaaactcatgaaaatgaatctccagctcaggtaataaagttgttctttttcaaatttgttctgctctttcttctctggccaatacaatcacaatccctaaattaatctttgcaagatgtacagagaaatgactagggcaggagtggcaattgggctataggctggaccttatgggctctcttccccatccagccttaaggaagtatgtactcctaataagggaatatgtaaatacttcttttaaaacacagaaaagccaccacatttaataattactatgttgtagtttccaatgaaagaaactgggaatctaatcttaacagctttctctctgggcacttggaggttatttgtgacttcagtcacttcgctcagtaggatataatgctcagaatgggtaattctggaatgcttagtatttttcaactatggattttgtattgctagagataatataacagctctagtagatgtaatcttgtctttctgcccatttgtttacagtgtcaaaattacctatttgctaaatttaaaaaatcattcttcatgaaattctcttattgaaaataagatgtactaatatgttcgcaagtttaagtaaaagacaaaccccattatatttcattgagagaaggatgaaatgaacggaagtaaacagtgctttatttccaatctcgagaaactaaaggatactccctgagaaaagaaaaacaacctttcacactcaattcacttcattctcctccactctctaaggctctattgtgggctcgctctgcttaagttttctccctcatcattttctaacatacgatatagtttacttagtatgtttattatctgtctccactattatgtaatgcaccagggcagaagttttgcttttttcatggcagcatctaaagtactgacagtacacagcaggtgctcaataaatatctgttgaatgactaaaagtgaatcatttcttcaggagagacctgctcatgatatgccaaataggctgaaggctaaagaatacagtataacagcagtctaatacatatatatatatatatatatatatatatatatatatatatatatatatatatatatatttgagacagtcttgctctgtcgccaggctggagtgcagtggcgtgatttcggctcactgcaacctccgcctccctggttcaagagattctcctgcctcagcctcctgagtagctgagactacaggtgcgcaccaccacgcccagctaatttttttgtattagtagagatgggttttcaccattttggccaggatggtctcgatctcctgacctcgtgatccgcccaccttggcctcccaaagtgctgggattacaggcgggagccatcgcgccaggcctacaaaatattttaatgttagcaatagcaaggctcaggtggaggcaacatctaagttcattataaacaattagcgatgcattgagttaaacaacaaagaaagcctgaaattccactagcaataattccgcatgtgttacggaaacacctagatggggactgttgccgggtttgaaggctcctccgtttgctaaaacttccagcactagagagtttattaaactactcctccaaagcaatgtgccctcactggcccctccccttgagaatcaacctcgagatctagcatctattttgcaaacgaagacagcaggaacgggcgggctaaccgtcgcagtcactgcctcggcgctcctccccctccaaggccagcaagttgcggcactgggggaaatggccgcggcgacaacttcctcgagttctctcgggtcatcgtgaacttgggcaccgaaacgaggatccaccccctccccaccaaagtgcgggagggaaaagaaggctagccagcgagaaattttgccccacaaatccgccagcagcagtggcgggaagcctcaacggcagcgaccccgccgctggcctcgtgcgcagctggtccccaccctcgcgcggcgctccctgatt

SEQ ID NO: 2610 - DNA, 59337 bp, Homo sapiens
caaaattccttatccaataatacataattaatttttattaacagtccaggatttgtttagcatcttgtttaacatttgaaaatcaaaacataaactttttggttctcaaggatagtgctattaaaagaaaatcttgaacatcagtggttagtaattttttacttacagaacaaaaacttctgaaatttcattgtgggacttaatctatttacattcctaaaactgagaataattaatgtatttgagatccttgtatgctagtatacattcataaggttctactgttctcatgaagccatttgactggcaaacatattcattacagtttcaaaagaaaacaccctatttgactcaccagaaaaacctttgtgatctatatcctactatttctgctgctgctgctgagcatggaatacatgtggggttgaaacaggggaggaaagagatagatttattagggtaataccaacttttatggctccccctgccccctccacctaaaattaggaggtcagtgaaagaactgcaaatgaatgtaaagaggaatatttcctgtactactgtagaaattttagagattaaaaacccctatgatttgttctgtaccttttgaacaatgaatgacacccctcccatctattttccaattttatagtaaaaatcggatttagaatcagaatctaaaattttcctttggtgtaaaaaatagttttgcattttatgaaaacaattgtccttttaaaaattaatcacatatataattgaatatattggttgcatatcagaagaaaaggtttaaggattaaagcattcaaagaacagtaatttggtggaatttcagtcagtgttatgggatcatgtcagagatgaacccttttatcaaaattccaaaggtggatccatattttataaaatttgataccaaataaattatgttataggaagatttcaatattgtctcaaacactggagaaaaaatttaatatagtcaaattacatgaaaaggcaagaatactgatcatgttgatggtatttctaatatttggaaaatgttataaaaaagaagtataaatactattcagattctgaaaaccatggcagacgcaaaattaaataaggagtaacagtaataaatgaattaaaaattagacaaaagcatattaaatgacaaaacagcaaagcaaaaatagaattgtcattaatattaaatagtatactgttgtaaaatatatgaaagtattaaaagtattataattaaaaatgattcttatcctaaatatgaaaataaatatcaaataatatgaaacataacatctaattgtttgataagaaaaaataacacaaagcagagaaaataaaagacacctcactattcccaatgtggttattatttatggaatggataaaacatgttgtagaaaaggtcattacagttaggttagcacataaaaaaccaacatgccacatctacctaaataattttgtagaacagctgaaaaagcaaatttcatcaaatttagacagcttatagtggaataactgagtatggtgaggtattaactaacactaagtttcacaacgggcagcttctagctggttcgttgaagctggatctcggccacgcaaggatcattggacaagaaatcagttgagctggaatagagctgcccaattgtcttaataatgaatgctccacactgtctgttaagtaaagagaaaatatagatcaggaagactgaatggaaaaaaaaagataagttagaacagatgagtacagaccatcaatcaacattcactaaatatttgcagaaccttggtaccaattaaattagaatgttacaaagtgagaggctagcaatttaggagggctccagaactcaggaaaacctgctctctgagagcttagaatctatattagacaatctctagtctagtgttacagtataaatgttgagtaaataaaatgagggatgggtcagcacagattacgagttacaacatttccttctattaggtgggtcttaaaaacttgtttttaaaaggggaatagtatttttggcaggaggctatttagaacgctgtccaggggaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgtgcaccgtgcgcaagctgaagcagggcgaggcattgcctcacttgggaagcgcaaggggtcagggagttccctttctgagtcaaagaaaggggtgatggacggcacctggaaaatcgggtcactactgcgcttttccgacgggcttaaaaaacggcgcaccacgagattatatctcgcacctggctcggagggtcctacgcccacggagtctcgctgattgctagcacagcagtctgagctctaactgcaaggcggcagcgaggctgggggaggggcgcccgccattgcccaggcttgattaggtaaacaaagcagctgggaagctccaactgggtggagcccagcacagctcaaggaggcctgcctgcctctgtaggctccacctctgggggcagggcacagacaaacaaaaagatcagtaacctctgcagacttaaatgtccctgtctgacagctttgaagagagcagtggttttcccagcatgcagctggagatctgagaacgggcagactgcctcctcaagtgggtccctgacccctgacccccaagcagcctaactgggaggcaccccccaccaggggcacactgacacctcacagggcagggtattccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagtgtctctcctcctccaaaggaacgcagttcctcaccagcaacagaacaaagctggatggggaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgaagaagcctcaggagccaatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttgagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcttttacagacaagcaaatgctgagagattttgtcaccaccaggcctgccttacaagagctcctaaaggaagcactaaacatggaaaggaacaaccggtaccagccgctgcaaaatcatgccaaaatgtaaagaccatcgagactaggaagaaactgcatcaactaatgagaaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccacctcacttgcagagacacacataggctcaaaataaaaggatggaggaagacctaccaagccaatggaaaacaaaaaaaggcaggggttgcaatcctggtcttggataaaacagactttaaaccaacaaagatcaaaagagacaaagaaggccattacataatggtaaagggatcagttcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaacagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaactgctcaaatacatggaaactgaacaacctgctcctgaatgactactgggtacataacaaaatgaaggcagaaataaagatgttctttgaaaccaacgagagcaaagacacaacataccagaatctctgggacgcattcaaagcagtgtgtagagagaaatttatagcactaaatgcccacaagagaaagcaggaaagatacaaaattgacaccctaacctcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgagcccacagaaatacaaactaccatcagagaatactacaaacacctctacgcaaataaactagaaaatctagaagaaatggataaatttctcgacacatacactctcccaagactaaaccaggaagaagttgaatctctgaatagaccaataacaggagctgaaattgtggcaataatcaatagcttaccaaccaaaaagagtccaggaccagatggattcacagctgaattctaccagaggtacaaggaacaactggtaccattccttctgaaactattccaatcaatagaaaaagagggaatcctccctaactcattttatgaggccagcatcattctgataccaaagccaggaagagacacaacaaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaagactggttcaatatacgcaaatcaataaatgtaatccagcatataaacagagccaaagacaaaaaccacatgattatctgaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacggggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaggctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaagaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatagagaccaatggaacagaacagagccctcagaaataatgccacatatctacaactatctgatctttgacaagcctgagaaaaacaagcaatggggaaaggattccctatttaataaatggtgctgggaaaactggctagccatatgtagaaagctgaaactggatcccttccttacaccttacacaagaattaattcaagatggattaaagacttacatgttagacgtaaaaccataaaaaccctagaagaaaacctaggcaataccattcaagacataggcatgggcaaggacttcatgtctaaaacaccaaaagccatggcaacaaaagccaaaattgacaaatgggatctaattaaactcaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaaccagttcaaccattgtggaagtcagtgtggcgattcctcagggatctagaactagaaataccatttgacccagccatcccattactgggtatatacccaaagggttataaatcatgctgatataaagacgcacacgtatgtttatcacggcactattcacaatagcaaagacttggaaccaacccaaatgtccaacaatgatagagtggattaagaaaatgtggcagatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaaaacttggacacaggaaggggaatatcacacagaggggactgttgcgggtggagcggggagggatagcattaggagatatgcctaatgctaaatgacgagttaatgggtgcagcacaccaacatggcacacgtatacatatgtaatgaatctgcacgttgtgcacatgtatcctaaaacttaaagtataataataataaaattaaaaaaaagaattctatttaaagtctgcataatgaaaaatgaagcagaaaattactgcaaaaatacactgtacattcttacaaagtgaaccattgagataactatttccaggttacatgatacatttgaggtaaaagttactgtaaaatttatttaaaaaaatggataagatcaaggggaaatgtgatctattttctctctttagaagcttttggaattttttctattattcctgccattctgaaatttcacaataattggccttagtgtgagtcttttgcagtaattgtggcaagtagttggtaggccttttcaatttagagactcttgtccttaagtttctaggaagttttcttctattaatttattgataatttcctccaatgatttttctctattcctctttctgcaatttaaaaaatatttgacttctgggattaatctaattttatcttttctctattattattcacctcagtcttttttgattctacgttctgaaaacttttgcctgtaatatttaactcacacataatttatttcaattatcacattagtggaaaaactagtgacattttagaataaggtgtatagtttagacgactgtactgatgttcatttcctgtgcctgtgccctctagccaaaggatgaagtaggtgaaggatatacagaaactctattatttctataacttctcagtaaatctgaaattatttcaaaatgcaaggctaaaaaaattaaaaggacagatatttgagagaaaaagtatcaggctgtctatgcatgtcccacttctcattagtttttgcctgtttcggagaggatattaattgtagtttctttgatattttcttctgctccctgcattgtatgtttcttatgaatttctttttttctgtttattttgttctctcaccctagaggttttcttctaacgtggctgcacgtcatagttaagagggaggcactaaaatcctaatgggaagttctttgtgcatggtttgtcagtgatcttcacttcaaggatttaagagaccatcgaactttttctctgtggtagaaagcatgcttggattagaatcctggatctgccacttactcaactatgctactgtgggcaagttactttttaagcttaaagtgatcaaattaacactgccagtaattagacatattggcatctcatatcccctgatatgacacactgataagggcatatcacctctgtgatattattgtcccaaattcataccctttatctaattaagagaaaacataggccaacaaaagtgaagagtgttctacaaaataactaatcaatattttaaaaaagaatcaaggtcatgaaagacaataaaagactatgtaaatgtcacagattggtggagaataaggagacatgacaaattaatgtaggatcttagattagatcctagaacagaaaaagaacataagtgaaaaaaatggtgaagtttgtagttcacttaataggtctgtagtttacttaacagtactttatgaatgctaatttcttcgttttgctaattgtttcaattataagctgttagaagttgagtgaagagatacatgaactctatgtattatttttacaacctttctgtaagtgtaaaattattttaaaataaaatgttaaaaaataggttaaaaggccaaggacatttggtgggatgggatgatgggggaggataactgccaggatatctatgcatgggttgcttctcattaattttgcttgaggcatgatgaatccttttttgatttgtaaattcaagtcacagtgtttttgattttgttttgctgttaaaatttctgcacattctttctgttccatttattctgtattcttttcttgagaattactatttttttggttggacctgtctctctgctctctctattctagcattttatctcatcatttaatctttcatgttattttcttttacattctggaagaattaaaaatatccctctctatgaaggatttcattttcttttgtgactactggccctttatgacaaaggcaaatatgattctttccatcatgtcaatagtttttgggcagtattttcttacactagccagcaaccatttcatttttcctgtttttcagcttgcaattgtttcttaaagatctattactgagaacatgggatacatcttaaaaattgtatttaatttcctctaatacatacgttcttatacatatatacatatttatactattcatccttgccttcaatgtagtgccatattcaattttttttcacagaatccatataatacatacttttctgtttactcatccttgaatggggatctactcatgacaattagaattggtgtcatgaacacttgattctccttactgtccttacatcaaaaaggagtcttggtagacacagaacctatacaatttctaatgtctaagtgggtgagcattttttgctcctcctgcctagttctttatgagtaaaaaacttattctagagaatctgaggctgtctattgtttgactatatatagcatacatgaaaatttataccctccttatatattcagagcttttcctgcctctgtcctctagattacattgctttatacttgtccttcccaggtttttcagaatacaagacaatttgagtctctaaattgattcataagtattaatgatactcaaatgaggaaatggttgggaaaaaaatactggtagtggaatctttttgtaaagcagatatagttgctaatttttaggtaagtgcacgctctgggcctctgaactagaagtagatagtggtagtagttcagatccctctccaatttacttctgaatcatactttgtcgaccattagttgtgtttttcatttaagtccaatcagtattttacttagaagaaattccttatagcctgggcaagaggttaaatatgatccttaatagccatatgttttcatcgattgttagtagacatgggagttaaataaaatacacattgaacttaatccatataagaacaattttattagatgcttatattaatgcaaaaatgtaaaaacactgtaagaaaaccaaaacacttgagaattctccacttatacccttcataccttgggatttgatatttatcttagaaacataatagttcacatacccagaaacacagattttccttttgttccttcctagtctagttcagtgggataattttgacattatgtggttttgctttttttgactttaaaacttaattctcttttatttcttttttaaaattagagatggggtctcgccatattgccaggctggccttaaactcctggctcaagtgatcctcctgccttggcctcccaaagtgctggggttcaggtgtgagttaccacacctggcctaaaacttgattctgtataagatgttactgctgaattagggaatgatggccctaattagtattatattaatctagttacctctatattggtctgttttgtatttattcgtttttgtatttgatttgacagagtatgtaggctgtggcttacagccaatgagtagtttctggtaaacagtacttcacagcagttagacttgtgcttcaaactctgcataaggtttctattttatggaatagatttgttgcttcaagataattttgacatttgaaattcctactttgggatatcttcaattaacattcatgagttgtaatcattagagctttaaaaatgagttttacgcttataaaaacaacaactcctccaaagaatatttccacctttctattttaaaagtcaccaagatttttggtactagagaaaatttgcattggaagtaaaaaaaggctaatgtttcaaatgtcattcactaatattttaatattagtaatatgttctagaaaaagattgtttcataatgtagaacaacatttgtatattaagatttccatgttataatagaaatgcactgtaaatgaaaatagataatttgccacatagtaatacatgcatattaaagcatttctacagcattatatagttctagaaaactacagaagtggttttggagtttctgtctctgagtggggtatcgttttgtattgagggccactaagtcacctaaagaaaaatattgagtataaaatgcatagaacatttaatcttaaaaaataaaaatgagaaacacaaaattctacataactatcttgtgctccagttttgactttggaagtctatttttttccatctctaacaaaagaggaattggtaattattattatttttttattttagagatatacatggtttcactctgttgcccaaactagaatgcagtggcgtgatcatagctcactgtaaccttgaacctttgggctcaagtgatcatcctgcctcagcctcctgagtagttagcactataggggtgcaccaccatgcccagatagtttttaaaatttttattttgtagaggctgaggagttagcactataggggtgcaccaccatgcccagatagtttttaaaatttttattttgtagaggcagggtctcactatgctctcaaactcctggcttcaagcaatcctcctaccttggcctcccaaagtgctgggattgcaggcatgagccaccacagttggccagaattggtaatctttatatgactatattaaagagtaagataccagtttctctgtacaatttctgatgttacctactcacagatctaagaacatttagagaaatatatactcttaaactagaagaattaaattttaagaatgtttaacattaacatcctttggaaatttctcctatccaaataccacccaccactccatcctctattcaaattattcaatttgtataattgtataaattacacaatttccatcactttgtgatatagctctctctcagtaactgaaaataactatcacttacataatatggcatagcaacatcagccatttctgcaaaagtatatttggagtaaatgttaacgacagaagaagtctattttagaagattttctaacaatactaaaaatgaagcctctatgagtaatgtttagtaacactataggttttgacaatatgtcaaaattatggttttatttcatgtttggtgtatagtgataaagccaatgaagggatgcagtgagtggtaatggcagtgagtggtaatggtgtgaagggtcacgagaagaccgggaggctccttaaagtagactgtcttggtattgagttcaacacataggatgggccagaacataaatatgagtgtgaaatagctaatatccattattttaatgcaaagactatgcctaccttcctcaccaaagtacactgtatgcaggattcatattaccatctcaacagttgatcagtctgtggctctttactgcagataaagttcatttccttaaagggatgatgcaagagtttcaccaagaaacttgttcataagggaataggaagaattccctgtacatagtagatagtcaaaatatattgagtgtatacatgggtataactggattatcattctttggcctgaatctgactaaggaggcatgaacatggttcccaaactggaaaaggagatcattaattgttttcacctccccataaatgtcacatgtcatcaacatagataataaaaatcagagtactgtatattaaatatctagaataggcaaattcatatagatagaaagtaaattagaggttaccagggactaggggttgagaggaagcacataggaagagttattgcttaatgggtgcacagagtttcaacttgggatgaggaaaaggtttgaaaacaatggtgatggttgcatagcattgtgaatgtaattaatgccactgaattgtacacttaacaatggttgaaacagaaaatttttaagtttgaagtcaggtagcgtgatacctccggctttgttcttttggcttaggattgacttggcaatgagggctcttttttggttccatatgaactttaaagtagttttttccaattctgtgaagaaagccattggtagcttgatggggatggcattgaatctataaattaccttgggcagtatggccattttcacgatattgattcttcctacccgtgagcatggaatgttcttccatttgtttgtatcctcttttatttcattgagcagtggtttgtagttcttcttgaagacgtccttcacatccctcgtaagttggattcctaggtattttattctctttgaagcaattgtgaatgggagttcactcatgatttggctctctgtttgtctgttattggtgtataagaatacttgtgatgtttgtacattgattttgtatcctgagacttttctgaagttgcttatcagcttaaggagattttgggctgagacaatggggttttctagatatacaatactacaaggctacagtaaccaaaacagcatggtactggtaccaaaacagagatagagaccaatggaacagaacagagccctcagaaataatgccgcatatctacaactatctgatctttgacaagcctgacaaaaacaagaaatggggaaaggatcccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagccatggcaacaaaagccaaaattgacaaatgggatctaattaaactaaagagcttctgcacagcaaaagaaactaccatcagagtgaaaaggcaacctacaaaatgggagaaaattttcacaatctactcctctgacaaaggatatctctaatatccagaatctacaatgaactcaaacaaatttacaagaaaaaaacaaccccatcaaaaagtgggtgaaggatattaacagacacttctcaaaagaagacatttatgcagccaaaaaacacatgaaaaaatgctcatcatcactggccatcagagaaatgcaaatcaaaaccacaatgagataccatcttacaccagttagaatggcgatcattaaaaagtcaggaaacaacaggtgctggagaggatgtggagaaataggaacacttttacaatgttggtgggagtgtaaactagttcaaccattgtggaagtcagtgtggcgattcctcagggatctagaactagaaataccatttgacccagccatcccattactgggtatatacccaaaggactacaaatcatgctgctataaagacacatgcacacgtatgtttattgcggcactattcacaatagcaaagacttggaaccaacccaaatgtccaacaacgatagactggattaagaaaatgtggcagatatacacctcggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaacaatgagaacacatggacacaggaaggggaacatcacactccggggactgttgtggggtggggggagtggggagggatagcattaggagatatgcctaatgctaaatgacgagttaatgggttcagtacaccaacatggcacatgtatacatatgtaacaaacctgcacattgtgcacatgtaccctaaaacttaaagtataataaaataaaataaaataaaaattttttaaaaaagaaaatttttaagttgcatatattaccacaataaataaaaaagttaatagttaatttagaattatatttccttcacatgagtttgctaattctgtacttctgatcacaagtgtgatgtaaatatccaaaattgttcctttctagaagagaaagttggaaaacttgaaatatgatggaagaaaaacaaagtaaaaagtcaaaacaaatttcttactttaattggctcaggctgcatcacaggcgcaggcatagtgatggcacttggagcataaacctggtgatatgttgcttgaactccatgatcagaataaggctattacaaaaaaagagagaaaaaatgtcacctttcatctattaattctaaatatttactcagcatttacaatatactaatcatctagctatacaatgtagaaacagttaaaaacacatgcccttatgtttaattaacttataatctgatgagttaatataatgaattaacttatgaattaacttgtaatctgatgagggaaatagacagtagtcagaatgatcataaatcctatagacatgtatagggatgcaacaggcaagggaagagattatgtaaatgcagttatggcttgtccagcagatggtggtaccattcattggaatatagaatacaaggaaagcttaatattcatgtaattgtgtgtaaggggttgcagagcaggagttaggtttgtgatatacaaaatttgtggtatctgtaggaattctagtagacgtatactgttgatagatgtggctctagaccaggactgtcaaatagaaatacaatgtgagctacatatgttatttaaaattttcccattgtcatgttagaaaaataaaaaatggtagaattaatttttagtaataccttttatttaaactaatacatattaaatattatcatataaaagtacaatcaatacaaacattaccaagatgttttacattcttttttcttttttttttgagatggagtcttgctgtcttccaggctggagtgcagtggtgtgatctcggctcactgcaagttccacctcccggcttcacaccattctcctgcctcagcctcccaagtagctgagactacaggtgccgccactacacccggctaattttttgtatttttagtagagacggggtttcaccgtgttagccaggatggtcttgatctcctgacctcgggatccacccgcctcggcctcccaaaatgctgggattacaggcgtgagccattgcgcccagctacattcttttttcacactgtgtcttcaaaacccagtatgtattttacacttaggggacatctcaattcggtcttactgcatttcaagtgctcaactgccacatgtggctagtggctattgtagtggatagtgcagtctaaaactcaggagtgagacggaggctagatatatggctatggatgataacatcagagtgagtacatgtggtgaaagaatggagaatcaaatacaaaatctgcttataaaggaaaacaaaaggaggtaaaaggattgccagaagagagtagtatcatggaaaccaagggtaggaagagttttagggagtaggtacaatgtctctgagaggtcaaataagataaaaaagaaaggaaagtttgtgtcagttaggaagtcattgaggacctttacccaaggcagcttcagcagaaaggtaatgaagtagacttcagcaggtgaggagtgaatgagtagtgaagtagcagaaattctgaatgtagactactttttcaagacacttggctttggaaggtagcagaaaatcagggaagtggtgggagtgtgtgtcacaggataatattgcctcttacaaggtgctgcacactatacaaagaactttgtataccatctctctagtctttacatcaatcctgcaaaatagtttttcctgatgtcctcattttacaaataaggagattatgaaagcaagaccatgaagggttaagcaattcctcaaagtaacacagtaagttgtgaagctgtaaaccagtggagagaagaagacttcaaatacaagacagaaaaagaacagtagatggaatgaggtccctgaggaggagggaactgatagcatctagatcgcaagaggcagaaataaccttggacaagactgaaagtcactaaataaatataagaagctaaggatgagttacgatacaggtaaagtttgtgtttcaggggttggaggctgagttggttttcacaaattggttcttactctgcaaaagagaaggcaaagctatattctcagaatgacatgggcaggcagtggagtgggtgcaatctggtagtactgagggcttggcaaaggtttaaaataatcattgaaataagtgagtgaagacggtcacttttttttttaaaaaaagaaatttgactataacactcacaagaaaagtcgtgaagttcttaattttagggaaaaaaacacttcaactgtaaaccatcccactctattcattaagttatatattagtcagactataccctctactagaaacagtagcaaaacaaaaacatgcaaatattttgtatggaaataccacacaaagtacaagttataagataatgatgggcaatattttcagaaaagctttattagattccattaaatagtgcatatattctgatggtaagtatctgatatcagatattaaaaatatgatttaatgccaaaagagattctgacaaaaaatcaaatgtaaaagcattcttatctcactacctgctcctggcaaaccagaaaacaacaaaaagaacaaaatatagatttttaaaatgccatcatcaattaaagaagaaaatgcctatgactcccaaaccatacacaatgtagaatgtctgccaagtgctgtgcaagttggacgaacataagggaggattctgaagcctcctcagtcatgagaaaggatgacgatttcccaagaggtcaatgttctggaagacctcctcaaagatactttagagtcttgagtgcagaagtatgtattggtcagagtgaggtagaagcacaaaatatctccacagagatcctattcataattaggataataattaataataattaagaatcctgacttaacaggggaggtagaattgatggagaaatcatgtttatataatttttcttgtctactatctagccttttacctgaggaatactgctggaggtgaagcagggagaaagtgggaaaggaagtagcaattgccacatcccaatacagaacccctgtgataaaaagggctttacaaggaacaaaaatgatctctggcaaggatgtggaggaaagggaatccttgtacactgctggtgggaatgtaaattagtatggccattttggaaaacagtagggtggtttctcagaaaattaagaatactatcatgtgatctagaaatcccactactgtgtatacatatccaaaggaaatgaagtcagtatgttaaaaagatatctccatttccatgttcactccagcattattgataatagtcaagatatggaatcaaccttagtgtccatcaatcagtgaatggataaagaaaatgtagtatccatatacacaatggaatactgttcagccttaacaaagaaggagatcctgtcatttatgacaacatggatgaacctggaggacattatgctaagtgaaataagccaagcacagaaagacaaatactacatgatttcacttatgtgcagaacgtgaaaaagtcgaactcatagaagcagagagggccaggtgcggtggcttatgcctgtaatcccagcacttttggaggccgaggcaggcggatcatgaggtcaagaaatcgagaccatcctggccaacatggtgaaaccccgtctctactaaaaatataaaaattagcccggcatggtggtgtgcgcctgtagtcccagctatttgggaggctgggacagggggatcgcttgaacccgggaggcagaggttgcagtgagccgagatcatgccactgcactccaacttggtgacagagtgagactctgtctcgaaaaaaaaaaaaaaaaaaagcagagagaagaatggtggttgccagggactggggatggcgagtgagatgggagatgttggtcaaaggttacagggtttcagttctaaaggaagaatatgccctgaagatctactgtatagcatgactatagttaataataacatattatatacttgaaaattgctaagacttaaagtaccttaaatgttctcaccacaaacaaaaaaaaggataaccatgtgaggtgatggattagcttgattggggtaatcatttcacagtgtgtacatatatccaaccatcatgctatacactgtaaatgtataccatttgtcgttagttacaatttagtaaagctgaggataaaaagaaaaaagcaaccataaaaaagtaggtggggcaggccaggcgcagtggctcacgcctgtaatctcagcactttgggaggccgaggcaggctgattacgaggtcaggagattgagaccatcctggctaacacggtgaaaccccgtctctactaaaaatacaaaaaattagccagacttggtggcacacgcctgtagtcccagctacttgggaggctgaggcaggagaatcacttgaacccaggaggcagaggttgcagtgagccgagatggcaccactgcactccagcctgggcgacagagcgagactcgggctcaaaaaaaaaaaaaaaaaaaaaaaaggtggggcatgaaacaaataataaagaaatcctagtaaaagtattgatagtaaatcttaagatccaactgtggaaattattgtttcagaacaaaattataatattaaaaaagtaataaaacaatgtacttaaactgggaggtaaatgctaatttcttaatctttcaccacactgatttaaaacataccatgcacatggtactggtacaaaaacacagaccaatggaacaggatagagaactcaaataagaccacatatttacaaccatctgattttcaacaaacctgacaaaaacaagcaatggggaaaggattccttgtttaataaatggtgctggggaggtccagggcaagatggccaaataggaccagctctggtccgcagcttccagtgagaacaatgtagaaggtgggtgatttctgcatttccaactgaggtacccagctcatctcactgggactggttagacagtgggtgcagcccacggagggtgagcagaagcagggtggggcgtcacctcacccgggaagcacaaggggtcagggaactcccttccccagccaagggaagccatgagggacagtgatatctggctcagatactacgcttttcccatggcttttgcacctgcagaccaggagatcccctcgggtgcctacaccaccagggccctggatttcaagcacaaaactgggtgcccatttgggcagacaccgagctagctacagggttttttttgttcataccccagtggcacctggaactccagagagacagaaccattcactctcctggaaagggagctgaagccaggagccaagtggtcttgctcagtggatcccacttccatggagcccagcaagctaagacccactggcttgaaattcttgctgccagcacagctgtctgaagtcgacctgggatgctcaggcttggtcaggggttggggcatctgccattactgaggcttgagtaagcggttttccactcacagtgtaaataaagccactgggaagttcggactgggcagaacccacctcagtactgcaaagccactgtagccagactgcctttctagattcctcctctctgggcagggcatctctgaaagaaaggcagcagccccagtcaggggcttatagataaaactcccatctccctgggacaaaacacctgggggaaggggcagctgtgggtgcagcttcagcagacttaaatgttcctgcctgccggctctgaagagagcaacagatctcccagcacagtgcttgagctctgctaagggacagaatgcctccttaagtgagtccctgacacctgtgcctcctgactgggagatacctcctagcaggggttgacagacacctcatacaggagagctccagttggcatctggtgggtgtccctctgggacgaagcttccagaagaaggagcaggcagcaatctttgctgttccgcagcttccgctggtgatacccaggcaaacagggtctggggtggatctccagcaaactcctacagacctgcagcagaggggcctgactcttagaaggaaaactaacaaacagaaagcaataacatcaacatcaacaaaaaggacatccacgcaaaaaccccattcacaggtcatcagcatcaaatatcaaaggtagataaatccacaaagatgaggaaaaaccagcacaaaaaggctgaaaattccaaataccagaatgcctcttcccctccaaaggatcacaactcctcgccagcaagggaacaaaactggacggagaatgagtttgatgaattgacagaagtaggcttcagaggtgggtaataaactcttccgagctaaaggcgcatgttctaacccagtgcaaggaagctaagaaccttgataaaaggttacaggaactgccaactagaatagctagtttagagaaaaagaaaagtgacctgatggaactgaaaaacacagcacgagaacttcgtgaagcatacacaagtatcaatagctgaattgatcaagcagaagaaaggatatcagagatggaagattgacttaatgaaataaagcgtgaagacaagattagagaaaaaagaatgaaaaggaatgaacaaagccttcaagaaatatgggactatgtgaaaaggccaaagtttaggtttgattggtgtacctaaaagtgacacggggaatggaaccaaggtggaaaacacactcaggatattatccaggagaacttcctcaacctagcaagacaggccaacattcaaatttagaaaatacagagaccaccagaaagatactccttgagaagagtttggtgggaagcccaccaaactaacagcagatctctctgcagaaaccttacaagccagaagagagtagcggccaatattcaacattcttaaagaaaagaattttcaacccagaatttcatatccagccaaactaagctttataagtgaaggagaaataaaatcctttacagacaagcaaatgctgagagactttgtcaccaccaggcctgccttacaagaattcctgaaggaagtactaaatatggaaaggaaaaaccagtaccagtgactgcaaaaacataccaaaatgtaaagaccatcgacactataaggaaaccgcatcaactaatgggaaaataaccagttaacatcacaacgacaggatcaaattcacacataacaatattaacttaaaaggtaaatgggctaaacgccccaattaaaagacacagactggcaaattggacaaagagtcaagacccattggtgtgctatattcaggagacccatctcatgtgcaaagacacacataggctcaaaataaagggatggaggaatatttaccaagcaaatggaaagcaaaaaaaagcaggggttgtaatcctagtctctgataaaacagactttaaaccaacaaagatcaaaaaagacaaagaagggcattacataatggtaaagggatcaatgcaacaagaagagctaactatcctaaatatatatgcacccaatacaggagcacccagattcacaaagcaggttcttagaaacctacacagagacttagactcccacacaataataatgggagactttaacaccccactgtcaatattagacagatcaacgagacagaaaattaacaaatatagtcaggacttaaactcagctctggagcaagaggacctaatagacatctacagaactctccaccccaaatcaacagaatatacattcttctcagcaccacatagcacttattgtaaaattgaccacataattggaagtaaaacactcctcagaaaatggtaaagaacagaaatcataacaaacagtctctcagaccacagtgcaatcaaattagaatgcaggattaagaaactcactcaaaaccacacaactacatggaaactgaacaatctgctcctgaatgactagtggataaattatgaaattaaggcggaaataaataggttctttgaaaccaatgagaacaaagacacaacataccagaatctctgggacacagttaacacactgtttagagagaaatttatagcactaaatgcccacagaagaaagagggaaagatctaaaatggacaccctaacattacaattaaaagaactagagaagcaagatcaaacaaattcaaaagctagcagaagacaagaaataactatattagagcagaactgagggagatagagacacgaaaaacccttcaaaaaaaatcaatgaatccaagagctggttttttgaaaagattaacaaaatagaccactagccagacggataaagaagaaaagagagaagaatcaaatagacacagtaaaaaatgataaaagggatatcaccactgatcccacagaaatacaaactaccatcagagaatactataaacacctctacacaaataaactagaaaatctagaagaaatggataaatttctggacatatacaccctcccaatactaatccaggaagaagttgaatccctgaataggccaataacaagttctgaaattaaggcagtaattaatagcctactaaacaaaaaaagtccaggagcagacagattcatagccgaattctaccagaggtacaaagaggagctagtaccattccttctgaaactattccaaataatagaaaaagagggactccttcctaacttattttgtgaggccagcatcatcctgataccaaaacctgtcagaaaccaacaaaaaaaaaaaaagaaaatttcaggccaacatccctaatgaacatcgaagcaaaaatcctcaataaaatactggcaaaccaaatccagcagcacatcaaaaatcttattcagcaccgtcaagttggcttcatccctgggatgcaaggctggttcaacatatgcaaatcagtaaatgtaacccatcacataaacagaaccaacgacaaaaaccacatgattatctcaatagacgcagaaaaggccttcaaaaaaattcaacaccctttcatgctaaaaacacttaataaactaggtattgatggaatgtatctcaaaataataagagctatttatgacaaacgaatagccaatatcatactgaatgggcaaaagctggaagcattcccttgaaaaccggcacaagacaaggatgccttctctcatcactcctattcaacacagtattggaagttctggccagggcaatcaggcaagagaaagaaataaagtgtattcaaataggaagacaggaagtcaaactatctctgtttgcagatgacatgattgtatatttagaaaaccccatcatctcagccccaaaactccttaaactgataagaaacttcagtaaagtctcaggatacaaaatcaatgtgcaaaaatcacaagcattcagcattcctatactccaataatagacagagaatcaaatcatgagcaaactcccattcacaattgctacaaagagaataaagtagctaggaatacaacttacaagggatgtgaaggacctcttcaaggagaactacaaaccactgctcaaggaaatatgagaggacacaatcaaatggaaaaacattccatgcttatggataggaagaatcaatattgtgaaaatggccatactgcccaaagtaatttatagattcaatgctattcccatcaagctaccattgactttcttcacagaattagaaaaaactagtttaaatttcatatggaaccaaaaaagaggccatataaccaagacaatcctaagtgaaaagaacaaagctggaggcatcacgctacctgacttcaaactatactacaaggctacactaaccaaaacagcatggtactggtaccaaaacagatatatagaccaatggaacagaacagagacctcagaaataacatcacacatctacaaccatctgatctttgacaaacctgactaaaacaagaaatggggaaaggattccctatttaataaatggtgtcgagaaaactggctggccatatgcagaaaactgaaactggacctcttccttacaccttatacaaaaattaactcacgatggattaatgacttaaatgtaagaactaaaaccataaaaatcctagaagaaaacctaggcaataccattcaggacataggcatgactaaaacactaaaagtaatggcaacaaaagccaaaattgacaaatgggatctaattagactaaagagcttctgaacagcaaaagaaactatcatcagagtgaacaggcaacatacagaatgggagaaaatttttgccatctatccatctgacaataggctaatatctagaatctaaacagaacttaaacaaatttacaagaaaaaaacaatcccatcaaaaaatgggtgaaggatatgaacagacacttctcaaaagaagatatttatgtggccaccaaacatatgaaaaaaagctcatcatcactggtcattagagaaatgcaaatcaaaagcacaatgagataccatctcacgccagttagaatggcgatcactaaaaagtcaggaaacaacagatgctggagaggatgtggagaaataggcatgcttttacactgttggtgggagtgtaaattaattcaaccactgtggaagacagtgtggcgattcctcaaggatctagaaccagaaataccatttgacccagcaatcccattactgggtatatattgagaagtttataaatctttcttctataaagacacatgcacatgtatgtttattgcagcactatttacaatagcaaagacttggaaccaacccaaatgcccatcaatgatagactagataaagaaaatgtggcacatacacaccatggaatactatgcagccataaaaaagaatgagttcatgtcctttgcagggacatggatgaagctggaaaccagcattctcagcaaactaacacaggaacagaaaaccaaacactgcatgttctcactcataagtgggagttgaacaatgagaacacatggacatagggaggggaatatcacacaccagggcctgtcagggggtcgggggcacggggagggatagcattaggagaaatacctaatgtagatgatgggctgatgggtgcagtaaacccccatggcacatgtatacctatgtaacaaacctgcacgttctgcatatgtatcccagaatgtaaagtataataaaaaaaaatggtcctgggaaaactgtttagccatatatagaaaattgaaactggacccgttccttacaccttatacaaaaattaactcaagatggattaaagacttaaatgtaaaacccgaaactatagaaaccacagaagggctgggtgcagtggctcatacctgtaatcccagcactttgggaggccgaggcaggtggatcatgaggtcaggagctcgagaccatcctggccaacacggtgaaaccccgtctctactaaaaatatgaaaatattagccagctgggcatggtggcacgtgcctgtagtcccagctactcaggaggctgaggcaggagaatcactcgaacctgggaggtggaggttgcagtgagccgagaccacaccattgcactctagcctgggcgatggagcaagactccgtctcaaaaaacaaaacaaaaaacaaacaaaaaaaccccaaaacacacacacacacacacacacacacacacacacacaaaccatagaagacaatataggcaatactattcattcaggacacaggcacgggcaaagacttcatgatgaaaacatcaaaagcaattgcaactaagcaaaaattgacaaatgggatttaattaactaaagagcttctgctcagcaaaagaaactatcatcagagtcaacagacaacctatagaatgggagaaaatttttgcaatctatccatctgacaaaagtccaatatccataatgtacaaggaatttaaacaaattcacaagaaaaaaacaaagaacctcgttaaaaagtcggcaaaggacacgaacagacacttctcaaaagaagacatttatccagccaacaaacataaaaaaagctcagcatcactgatcattggagaaatgctaatcaacacaatgagataccatctcacaccagtcagaatggcgattattaaaaagtcaaggaacaacagatgctggtgaggctgtggagaaacaggaacgcttttttacactgttggtggaaatgtaaattagttcaaccattgtggaagacagtgtggtgattcctcaaagacctagaggcagaaataccatttgacccagcaatcccattactgggtatatacccaaagaatataaatcattctattataaagatatatgcatgtgtatgttcattgcagcactattcacaatagcaaagacatggaatcaacacaaatgctcatctgtgatagactcgataaagaaaatgtggtacatatacatcatggaatgctatgcagccataaaaaggaaagagatcatgtcctttgctgggacatggatggagctggaagccattatcctcagcaaactaacacagggacagaaaaccaaacactgcacgttctcacttgtaagtgggagctgaacaatgagaaacacatggacacagggaggggcacaacacacattgggacgtgtcggggctgggaagggagagcatcaggaaagatagctaatgcatgccaggcttaacacctaggtgatgggttgatagatgcagcaaaccaacatggcacaggtttacctatgtaataaacctgcacatcctacacatatgtactggaacttaaaataatataaaataaaaaatataaaataaaacataccatgcacagttcctggcatacagatggtgaagctataagtaacggatcagaaatataatttaaagatgctgaagaggatattaaaatttgtaattataaatttaatttacatttttgtaggaagaatttttttaaagattttttttcttcttcatcttaattatatgcttttgactaatagaatgttagtaacaatacagattgacaggcaaaatgagaatgcagagtatttggaattttactatttcaaaaagatcaaatcaaagattagcttagtggagtgaatggttgatttgggaaatggttcagaactagttagcgaaaaagtctaagatgatgcattcttagatataagaaaggggaagagatttgaataaatcaacaaaacaaagatgaagcagtttcaatgagggtcgtgaacaaatttaaaaaagagaaaaagaaataaatgttaacatgaggtagttatagatcaattactttaagactaatacatacctctggaactgaagtttccatcagagacagtggaggaggaacacatccaccatcctgtgcaatttccactggttgataaataacctcagaaggttgcaggtataagaatggagcagaagaggcagaaggctaaaatacaaaaccatatttctaattcaaatatgattagttatttctgttaaaccaaatgacttagccaacagatgagagaagtacttgttttttattttactaaatttttttttaggaatagcacagaagtatctcagcaacggattagaaactgatctgttataaattccaactgtgtagatgtagttaaagaatcttatcattggtaagcactagaacttcttaatgactgagaacctcatatataaattcagataataattatggttatattaatgtcaccagtaaaggttgtgataatgtgatctatggtatttaaattgacataaatgtctactctcagctctgtgacttctaatgaaagtgggaaaatgtgaaacttttttggtgaagtactatttgttaccaaaagttgggaaatagaatacttatttaggaacagaataaaaactgaagccaaatccaaatgaagttagaaaaatgctaaattttcaaataacactaatagtaaaaaagggtaagttttcatgtttatacagtacacatttataaaatgctttcacttatgcattatcatttgatattcacaaaaatcatgtaaggaaacttacaaaggtatagtatcattatatccattttacaaatgaagaaactgaaaatgaactgccaaaagaataagttaataaacagaagaagaaggtctcaaatctaaaaaactttagtattcatgcagtcatcacaagaatataatgaaagaaggatttaaaattatatattgaaagttaacatttacctgaggaacactccactgccactgtcctggtaaatactgtgtggtggcctaaaattaaataaaagaaaagaaaaacccattctgattataaacaagggttaaaactagatatctacaggcaaaaatatgaagttggaccctcacaccatatacaaaaattaactcaagccatatacaaaaattaactcaaaatggaccagagacttaaatgtaagagctaaaattatacatctcttagaaaaaaacataggtgtaaatgcctgtgaccttgaattaggaaatgtttttaaaattatggttccaaaagcataaacaacaaagcaacaacaaaaaatagttaaattagatttcatcaaaactttaaaaaacttttgtgcaagtgaaaatacaacccacaggatgagagaaaacatggaacttatatcaagaatgtataaagaactcttacaactcaataatcaaaagacaagtaacccaacttaaaaattggtaaatgatatgaatagacttttctccaaagaagatatacatatggccaataaacacaagaaataatgctcgacaccactagccttcagggaaatacaaatcaaaaccataatacaacatcacttcatacctactaggatggctttaatcaaaaaagtagatcataaatgttgacgggcacgtggagaaattagaaccctcataatctgctggtgggaatgtaaaatggcgcagccctttgggaaaataaacacttccttaaaaggttaaacaaagttaccgtatgacccagcaattccactctagttataaaacctaagagaaataaaaatatgtgttcacataaaaatttgtatgtgaatgtccatcgcagtatcatttataacagtcaaaaagtagaaacaactcaagtgtccatcatctgatgaatggataaacagaatgtggtacagtgtatccatacaatgggatattatttgagaacgaagtactgagatatgtcatgtctcatttatcatgacatagataaatcttgaaatcattatgctaaatgaaagaagcctgtcacaaaagaccacatattgtatgattgtttttataggatatatccagaataggcaaatctagaaaaacaggtaagtagattactggttgcctagcactgggataaggggaaaaagaagactcaactcatctactgtagcacaaaaacagccatagacaataagtaaacaaatgtggctgtgttccaataatgttttatttacaaaaacaggctgctggctggagtttggtctgcaagccatagtttgatgaccctgctatagaccagaatgatctggcattatagttcacttatccccaatttctcactaaaattaatgaagagtgctggttaactgaaagaggatatcataatatataataaaccacaatatattatttgctttaatataaattatgttaaatataatatagcaagaaactgacatatgttaacattaaaaaaccagcttgcagtccaatacctgtatcttacttggggaattattgctaaagactttttagatctaaatgttagccaggggagcaaaactgacctcatcacatttggtaaaaggaagcaaagagtccatccatcttcttgtatgacattgtttaattccctcgtaaaaaaagagaggcatgatgtcagcaagatggctgaccagagatgcctagcattcattttccactggctccccaccccgccacaagaaaagactaaggcaaagaataaacagctacaatttgacaggagcatcaaaaggagagtgctggagtgccgcaggggagtggagacacacctgtggtgattgcaaatccaggagcgcagcatggagccacccagcctctgcaaacccttctcttctgctaggattggttctgcctggagtcctgcagtttcttattgcagggaaaaggtaagcagaagatccccaccagcctgcattgctactgcaaacagccacactccttgcaacaggagaatcccacagtctcacagtttgaagagctgctgggaattcgtggctgcattgccccgaattaggagtacaaagtgtgtactccccaccccctcaaccccaccctgtgagcgaagctgctacagcgtgacagcatcttgaagccatagtcatctctagggggccagtagctattgcacgtctccagtactggggttccattttcattctgccaagtacacaccagtggctgaacacaacctcagcagcatggaacctgaggctcaagattggctgtgattctggttctgtacagtagggaaaccaacgtctgttgccctcacctccagctagaggaacaatctggctgacctgcccagggtgaacccactctttagctggtcaaactgctgcactctcctgagcaggacaggtcctcaagcctcgtagtagctgacatgctgccgggatggaatggttacacacctgcatacagggctgagaaacagcccagaggtgcctcacgccctgcagacaagcccctgacctaccctgtgcatgcaattagagcccaagaaacagctccggggactgccactggcagaaatgtccccaggggagtggagtggctgtgtgtccatgcctcaggcctaagaaatggcctcgtgcccacccctccagcagacacgtccccaggacagctgagcagcctggagcctgtgtcccaggcctgaaaagcagccccataggctgcttccagtgggcatgatcccaggccgaccaatagccctgtgcctgcattctgggcctatgaaacagccctcacagaaacgtttccaggccgggtgatccaccctgtgcctatgtcccagacttgagaaatagctccgtgggccacccccagcagacatgcccctaggccaggtgagcagttgtgcacctgcatcctgagccggagaaacagcccctgacaaacatgtccctagccgactgaacagccatgcagctgtattccaggcctgagaaacagtcccatgggctgtccccagcagatgcacccccaggccagcgaaggagccatgtgcctgcataccagacctgagaaacagccccacaggctgcctctggtgggcactcctccaggctggctgagaaactgcatgcctgtgctctcagccagagtaacagccctgtggccccaagcccagtgagccagacttaccatgttcatgtacacagccctgacctgaggaacagctcagcaagcccacccctggcaaagccctaccaccattgtcatagactctcttttgctaggtcactgagaaacttggaaacacaactagagagtattacagcttaagagactaaacagagactaccctagcagataggttgaatctagcagattcaatctaaacagatcctctcagaggcacattatagtcaaattgttaaaagtcaaagagaaagaaagaattttaaaagcagcaagaaaaaagtatcaagtcacaattaaaggaatccccattatactaacagcagatttcttagcagaaatcttaccagggagaatgggatgatatatttagatatattcaaaatattgaaggaaaaaaacctgccagccaagaatattatacccagtaaagctatccttcagaaatgaaggagaaatacgatctttcacaaggccaggtgtggtggctcatacttgtaatcccagtgctttgggagactaaggcaggaagattgcctgagcccaggaatttgagaccagcctgggcaacatagcaagaccctatctcttaaaaaaaattagcaggcagggcacatgcctgtagtctcagctgtgtggcaggctaaggtgggagggattacttgagctcacgagtttgacactgcagtgagctatgatcatgtcactatactctgtctctaaaaaaaccagctctttcatagacaagcaaaaactgagagaatttatcaccactagattggccttacaaaaaaaatactcaagggagtctcacatcaggaagtgaaaggatggtaacaacgatcatgaaacatgcaaaactataaaattcactgggacagccattacacaaaggacaaaaagaagaaaagaatcaagccttataattacagagaacccagctgcaaaaaatcaccaaaaagagagggaacaatgaacaaaagatatgcaaaataaccagaaaatgataaataaaatgacaggatgtcctcacctatcaataataaccctgaatgcaaatgggttaaattctccatttaaaagatagagactagctgaatatattaaaaaaagagacccaactatatgctacctaaaagaaactcaccttacctgtaaagacacacataggctgaaagtgaagggatggaaagacatgtttcatgcaaatggaaaccaaagcaggcaagagtagctatacttatatcagacaaaaccaacttcaagttaaaagttttaaaaagagacaaagaaggacatttatataataatatagggatcaattccgcaagagaatataacaatgtaatacatatgtacccaacaaaaagcacccagatatataaagcaagtcttatttgatctaaagagagagggagaaaccccaataaaatagtggttggggacttcaacaccccactctcagcattggacagattatctagaaagaaaataaacaggccgggcacagtggctcacacctgtagtgccagcactttgggaggccgaggtgggcagatcacaaggtcaggagttcgagaccggcctgaccaatatggtgaaaccccgtctctactaaaaatacaaaaattggccaggcgtggtggcatgcaactgtaatcccagctaccgaggaggctgaggcaggagaattgcttgaacctgggaggcggaggttgcagtgagccgagatcatgccattgcactttagcctgggtgacagagcgagattccttctcaaaaagaaaaaaagaaaagaaacaaagaaacatggatttaaactgcaccataggccaaacagacctaacagccatttagagaacatttaactgaacagctgcagaatatactttcttttcatcaggatataaaacattctccagaattaccatatttcaggaaacaaaacaagtctcaaaaaattaaaaaaaactgaaattatataaagtatcttatctgaccacaatggaataaaacaagatatcaataacaagaaaaacattcaaaactatacaaattcatggaaattaagcaacatactgctgaatgaccagtgggtgaaggaagaaattaagaatgaaaatagaaacacagcataccaaaacctatgggacacaacagtagcagtattaagaggcaaatttataacaatgaatgcttacatcaaaaaactagaaatatttcaaataaacacccttacaatgtacctctaggaactagaagagcaagaacaagctaaacccaaaattagtagaagaaaagaaatagtaataatcagggcagaaataaacaatgttgagactacaaaacaatacaaaagattaacaaaacaaaaggttgactttttaaaaagataaaatcgacaaaccattagctagtctaagaaaaaaaagaaagtagacccaaataaataaaatcagcaatgaaaaagacaccacaatgaataccacagaaatacaaaggatcattagaggctaatatgaacaactctatgcaaataaattaggaaacctagaagaaacggataaattcctgaacatatacaatctgccaagactaaaccaagactgaagaaattgaaaaccttaagaaacaaggccgggcacggtggctgacgcctgtaatcccagcactttgggaggccgaggcgggcagatcacgaggtcaggagatcgagaccatcctggctaacagggtgaaaccccgtctctactaaaaatacaaaaaattagccgggtgtagtggcgggcgcctgtagtcccagctactcggaaggctgaggcaggagaatgacatgaacctgggaggcggagcttgcagcgagcagagattgcaccactgcacactccagcctgggcgacagagagtccgtcttaaaaaaaaaaaaaaaaaagaaagaaaaccttaagaaacaaatttaagtaacaagattgaatcagtaattaaaacgtcttccaacaaagaaaagtccagaactacatggctgaattctaccaaacctttagagaagaataccagatcttcccaaactattccaaaaaattgaagcagagggaattctccctaattcatcccattagtttgattatattaaactaaaaagttcctgcacagtgaataaaacaatcaacagagtgaacagacgacctgttgaatgggagaaaacatctgtaaactacttatctgacacagaattaatacccaaaatttacaaggaactgagacatctcaacagcaaaataaacaaaaaataaactgattaaaaatgggcaaatgatctgaatagacatttctcaaaagaagacaaagaaatggctaacaaatacatgaaaaaatgatcaacatcactaattatcaggaaactgtaaatcaaaaccacaatgaggtattatctaccccagttaggatgtttattgtcaaaaagagaaaataacaaaccctggtgaggatgtagagaaaagggaactcttatacactgttactaggaatgcaaactagtacaaccactatggaaaacagtatggagatccctgaagaaactacaaatagaactaccatatgatctggtaatcccactactgggaatttatttggagaaaaggaaatcattgtatcagagagacatctgcacccccatgtttattacagcattattcacaatagccaaaatatgaaatcaacctgggtgtccaacaacagatgaataaagaaaatatggtatatatatacacaatggaatactatttggctataaaaaagaataaaatcctatcactcatggcaacatggatggaactggaggtcattacgttaaatgaaataagccaggaacagaaagttaaacaacacatgttctcactcatatatggaagctaaaaaacactgatctcaaaaatctgccacctgcacagatatttttgaaagaaacaagttttatttttccccctttcttgtaataagtgataaaattccaagtctttttcactgccttccaaaccatgttcagaagagagtagcttatcctctgctggtctacactggttgctgaatttacttgtattcctgtttttgtatatgctgcatttagacttacatatggcaagaaggcatttttgttgttgttgttgttaaaggaaacaaactctcaaatcatgaagtgatgtaaatgttgcatatgcctacaaagctctgaattcaggtcccattgctgtcacaaagaaatgaatgtaactcctaccctaatcccttttttatataataaaactgccttagcatgagttgcaactgtcatcactacagtaagctggtttacagatgttttccactgagcatcacaataaagagtaccatgtgttacaaaaaaaaaaagttgatctcatagaagtaaaaagaatactaggggctgagaaggatagagggaaaggaggaatagggagaggtttgtgaaaggatacaaaattacagctacctcaggaatggaaaaccaaacatcctatgttctcactcataagtgggagctaagctatgagtatgcaaaggcataagaatgatacaatggactttggagacttagggagaaggagtaggaagagggtgagggataaaagactacaaattgtgttcactgtatactgctcgggtgatgggtgcatcaaaatctcacaaatcaccattaaagaacttactcatgtaaccaaataccatctgttccccacaaacctatggaaataaaaattaaaaaaaaaacaacaaaaaatccaaaacacctccaaaattacagctagataggaggaataagttctaatgttttataccactataggatgactatagttaacaataatacatagtttcaaatagctaggaggctattgaatgctcccaacacaaagaaatgataaatgtttgagatgatggatatgctaattactctgatttgatcaccatattacatgtatcaaaacatcactacataccccatgaataggtataattatcatttgtcaatgaaaaaaaattaaaaaaaaaacactaccaaggattaactatctcttttttattttttattttctaactaatcatttattttattttacttatttttaaaacttttattttaggttcaggggtacatgtgaaggtttgttacataggtaaactcgtgtcacaggaggttgttacacaaattatttcatagcccagtacccaatagttatcttttctgctcttctccctcttcccaccctccaccctcaagtagaccccagtgtctactgttcccttctttacgttcatgagttctcatcatttagctcacacttataagtaagaacatgtggttatttggttttctgttcctgtgtcagtttgctaaggataatggcctctggctccatccatgtccctgcaaaatatatgatctcattgttttttatggctgcataatattccttggtgtatatgtaccacattttctttatccatctgtcattgataggcattccatgtctttgctattgtgaatagtgctgcaatgaacattcgcatgcatgtgtctttatggtagaatgatttatattcctctggctatatacccagtaacgggtctaatggtagttctgcttttagttctttgaggaatctccatactgctttccacaatggttgaactaatttacactccaaccaacagtgtataagtgttcctattctctgtaacctcgccagcatctgctatttttgactttttaataatagccattctgactggtgtgagatggtatatcaatgtggttttgattcacatttctctaatgaactatctctttgtaattagcaaagtagttgcatgagaaagaaataaatgaaagttagctaagaaaggactgaaagtttcagagagaattttaattgtaatttatgtttacctggtagtgatatgcaggttgctgataaatgggctgagctaccatcacaggggagctacatacagaacgtgactataaaaggatggaaaaagaaaaattaggcagaagcctttaaaatagctcacaataaaatttatctcaaattattacctaaacccagtaaacttctggtttatgattagaaatattatttttctacctcttattgatatgattaccaactctactaagtctattaaaatcatcacaatatttctacttctacgtggtttcatttccatagtaatgctaaaacaatcaccagaaaagttgtttttagtctgaaatgtaccatctccaaagattatgaaaatatagttataagagaatacttagaggaaaatgacagcaagacttagggtgacgctgcctgtttccattgtggggaccagcaggaaacagttaatgtttataatagtgtttagaactgaatgaatagtcgtatctaattttcccactagttacaaataatcaatgttctattcctttgttatacctataattaaagcaaagatattttatttttattttagtaatttgacatttaaaagagttaatagtttgataaacttacaagtgaaaaatctgtgctgaaaaaagtacaggtaacacttgattattcaaagtgaaagagtaagccccaaaacagattacttaaaaccagatctttaataaaacaggcaagttgtattgcaagatagtaaaactggctctaatgtagcaattaaaattcagtgtctaatgtgggatctaacttatattgttttgtttaatgtttgcacccccgaaactgaggaaaagtatcacagttttgtacaattcacagactatggtatgctaataaaactgtatcactgattaacattagaaaataataatgtaatttcccatattaatagattaaaggagaaaaaatggtaatttcaacagagacagaaaatgcatttgttaaaattccatacctttttatgattaaaaactcttaacaaacatggtagaaaatggcttccttaattgatttagggcagtaactctcaaccatgagtgattttgtcctatagggaacatctggcaatgttgggagacatttttgattatcataactatggggagcctagggatacttctaaacatcctacagtgcacaggacagaccttcacagcaaagaaataatctggctcaaaatgtcaacagtgctaagattgagaaagtctggttaagagtatcttcccacttacaaagtatgcgtgtgtgtgtctatatatgtatgtatacatgcatgcatacatgtaaagtttaatggtgaatcactgaaattgctccctttttcaagaacaaggtcatgatgttttcactacatcaatactgtagcagagacatggtcagtgcaaaaactccaggaaaaaaagaagtgaaagaaatagaagtacactgaatcataaataattgtgtaaatgagagtttggcagggttactgatagattatcactattgaaaaatcaagagcattactatacaccagctacaatctattaggaaatgttatttaaaaaacagcattcattaaagcaacaaaactatagtctactaagaataaatttgacaaaatgtgtcacgcttttttatggagaaagaaaacttttttatggatagaagtaaaataagacaaataaatggagagatgtatcatgttcatggataggaagattcaatattttaaaatactgaaatgtcccaagttattcacactatttaatgcaattctaataaaaaaaagggcttttcactgaactaaacaaactgaattaaaaaatttatacacataaaagcaaagacataaggatagatgagagactcctgaagatgaacaatgtactttaagatttcaagactcgttataaagtcaaaataattacaactgggcaaggtgaacaaatacaccaatggaacaaaatagcagaaaaaagacccacacacatggaaacttagtgtttggcagaggattaatttcaaaatagcaggaaataggtggattagtcgatacataaattcaagatttaagatctagaagtgaaaagtggcaatactatagcattaaaaataaaaaatagcatatattcttgtagtaaaaaacaaaaaactaaaaaagaagaaaaaatcttgtgccagttttcaaagggaatacttccagtttttgcccatctagtatgatactgactgtgggtttatcataaatagctcttattattttgagatacgttccatcaatacctagtttattgagagtttttagcatgaagggctgttgaattttgtcgaaggcctttcctgcatctattgagattaatcatgtggtttttgtcgttgggtctgtttatgtgatggattatgtttattgattcgtgatgttgaaccagccttgcatcccagggatgaagccaacttgattatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttagggaggattctctctttatctattgattgaaatagcttcagaaggaatggtaccagctcctctttgtacctctggtaaaattcggctgtgaatctgtctggtcctggaatttttttatttggtagtctattaatgattgcctcaatttcagagcctgttattggcctattcagagattcaacttcttcctggtttagtcttgggagggtgtatgtgtccaggaatttatccatttcttctagattttctagtttattggcgtagagccctctctcttcactcctattcaacacagtgttgaaagttctggccagggcaatcaggcaggagaaagaaataaagggtattcaattaggaaaagaggaagtcaaattgtccctctttgcagatgacatgattgtatatttagaaaaccccatcatctcagcccaaaatctccttaagctgataagcaacttcagcaaagtctcaggatacaaaatcgatgtgcaaaaatcacaagcattcctatacacaataacagacaaacagagagccaaaccatgggtgaacgcccattcacaattgcttcaaagagaataaaatacctaggaatccaacttacaagggatgtgaaggacctcttcaaggagaactacaaaccactgctcaacgaaataaaagaggacacaaacaaatgggagaacattccgtgctcatggataggaagaatcaatattgtgaaaatggccatactgcccaaggtaatttatagattcaatgccatccccatcaagctaccaatgactttcttcacagaattggaagaaactactttaaagttcatatggaaccaaaaaagagcccacattgccaagacaatcttaagcaaaaagaacaaagctggaggcatcacgctagctgacttcaaactatactacaaggctacagtaaccaaaacagcatagtactggtaccaaaacagagatatagaccaacagaacagaggcctcagaaataacactacacatctacaaccatctgatatttgacaaacctgacaaaaacaagaaatggggaaaggattccctatttaataaatggtgctaggaaaactggctagccatatgtagaaagctgaaactggatcccttccttacaccttatacaaaaattaattcaagatagattaaagacttcaaatgttagacccaaaaccataaaaaccctaggagaaaacctaggcaataccattcaggatataggcatgggcaaggacttcatgtctaaaacaccaaaagccatggccacaaatccaaaattgacaaatgggatctaattaaactaaagagcttctgcacagcaaaagaaactgccatcagagtgaacaggcaacctacagaatgggagaaaatttttgcaatctacccatctgacaaagggctaatatccagaatctactaagaacttaaacaaacttacaagaaaaaaatcaaacaaccccatcaaaaagtgggtgaaggatattaacagacacttcttaaaagaagacatttatgcagccaaaagacacatgaaaaaatgctcatcatcactggccatcagagaaatgcaaatcaaaaccacagtgagataccatctcacatcagttagaatggcgatcattaaaaagtcaggaaacaacaggtgctggaggggatatggagaaataggagcacttttacactgttggtgggagtgtaaactagttcaaccattgtggaagtcagtgtggcgatttctcaaggatctagaactagaaataccatttgacccagccatcccattactgggtatatacccataggattataaatcatgctgctataaagaaacatgtaaacgtatgtttactgcggcactattcacaatagcaaagacttggaaccaacccaaatgcccatcaatgatagagtggattaagaaaatgtggcacatatacacaatggaatactatgcagccataaaaaggatgagttcgtgtgctttgcagggatatggatgaagctggaaaccatcattctgagcaagctattgcaaggacagaaaaccaaacaccatatggtctcactcataggtgggaattgaacaatgagaacacttggacagaggatggggaccatcacacaccagggcctgttgtggggtggggggaggggggagggatagcattaggagatgtacctaatgtaaatgacgagttaacaggtacagcacaccaacatggcacatgtatacatatgtaacaaacctgcacgttgtgcacatgtaccctagaacttaaagtatataaaaaaaagaaatgcaaaaaataaaaaataaaaaccactaaagcagtactatatgtcatttatgaatacatatatttgtagtaaaaatatataaaatgaataggaaagatattctgcttacttttgaacaggaaagagggtaaggaagtgggggtaaggagaattgacctgaagctgtcttactttactccccattttaagaacttaagtaaatgtggcaaaatgttgatgtctatttaatttggttgatgtgtgttattatttgtaattatctgtggttaagatatttcagaaatataacaaacattaaaaaattgatagtaatagatggaaatccttttttaaatgaaattacttacaggccaaggcggtgggaccgaagttacctctggagtatgaaaataagcaacaccattatggtaagtataaggatatccagttgaagttgttagatacattgttccagctgctggcattatactagaacctaaagcaaagattaaataataataattgaaatgttcaatttaactgttaaaaatgtagtttctaaacacttcagaaaaatatttatcttaatatacctatgtagctatggtaaaaattgaatgtcacagatatttttaaaaaattccttatgtcaaagtatctttgaagcctgtatttttaaactcaataccttaaagcttttagtttaagatgattaaaagaaaagaaaaacaatacgaataagaaataccaaaaatgtatcaattcagattccaacaccagtatgctacacaaagctgaacaatttagactatcatcagcgaagtaattatttgtacaaatataaattatgtataatttaaagttacttcaagacaacatacactgtagtgaagttcctaaggtcttggctagaccttttatttctgaaagtccaaagatgatggaggcagtaaagttggagaagattctactttcctgaagacattttggttccaccctactaattctttggatatcctaccagcaaacattcgttcatgctatggctgtcttttatctctcttttctatgatctattctctatctagtctccctttgctacaactgctgctgttgcaaacatgaccgcaagtcttcatgtggctagtctggggtccccaactcttttcccgggccaagttatataaacccccaccacaaaccaaaaaacagtaaataatatacatagatatatatatattttttgtcattgaggagactttaaaagttaaattagccaaattagattaggtcttaaccagcaaggttatataaattagtgaaactgacaattcttccacctataccagtgcttctcaaaatttcccataaattagaatcacttaaattgttttctaaaatgcaaattccagggacttatcttcagagattttgagtcagtaaatctgggacagggcctaagaatttgcattttgacagcttccaatgaaatgacactgtctgcaaaccacacttcaaatagcatgggcctaccactttaaataatactattgctcctcagcttttatattttcactgcatttgatctagtattgttattatttattttaatggttcttaattagatccttttgagaatttgatgaaaatcagggaccttttcctcagatatatatacagtcaaacacaattttacacacaattttggaggtccatggattccccccaaaagatattccactattattcaaagataatgataatggttcattattcaataatggttcattattcaaagaaaatgaaccatgctttacctgctaaataaataaattttcagtgcatactatttcaaggcattgaacagggccctagtgatacagcaaaaaataaaaaaattagacatgagatggtctgtatcctcaaagaagttaggtctggtagtgaagatagtcattagttgattacacaattaattaattaaatacaattttgataaatacatgaggcattatagggtacgatactgaacatttcaattattatgtatacaaaacatatataaaatttctctctatatacatatatatggaaaatttgtgatgaaatgatgttcagctaagctctaaagaatgaattggatggcaaagtacattctaggtaaagaaaacagtatattagattctgagaacaggagtatagaatgttctggaactgaaagaaggctacatggctaaagcatggaaagaaaagggaagaatacctcaaaataagctgagcataagacaataagaggtgcacttttgaaagatcactctggctgccttgtgaatgatggattggaaggtagaaagattggattcagagagaccacttaggatgtttttccaggaattaaggtaaacaaagtggttagttgggactcgggtgttggtaatggagatggaaagaaatgacagatctaagaaaaaactaagataagaatcccttatttgtaaatgtacttttaacacctatttttcttcgcagaaaagtcaaaagaactttggagtcaaacagtcctgcatttgaaggctagtgctaccactcaccattaggctatttaaccccatacttcttaaagttggataagggatggatggtataccaggagatatgaaaaagcagaggctgaacatagtaatcttcctacagaatcagttttattcaattgtttttgggaaatatttttatattcaaataaacaatatgatattatggaacagaatgcaaattatacatgatgtttttgcataaatcatgagactttaaagaaaatttgcaattccagtatgctgcagtgggttaggaaccacaacatgccaagattaactctcctctacctttaggagtatttcagcagaaacatttttaaaacaatgactttatctttttgggattgaattttctatttacaaaaatagagataacaatacatcatgggattctatgaagattaaatgaaaactcataacattgacccttgcactaagtagttttgaaaaaactatttgtatatgtgaaagcattcagcatagtgctgatttattttctatttcagcaactggtagatcatactatgagcattactatttagtacatattgctggtgataatgggctaacggaccgttactatatgttctagcttaacctttgcaagtaacaacagtagattgaaaatattcagcattctgccatatttagtgcattccattttgtattaacctactgaggatactttgattgtctcctaaattaacaaatactaagtcaaaattaaacttaatatacatcaatctcttttttgttgtagttgtggcaactgtattaaccaaatatctattatttctaagtcaaaagcataacagtccaaatgaatacaatctattaatttgttaacagattatatataataacctaatgttttaaacattcccgtagacactaggatgtggctaagggaaaataagttagttataaattttacatcacatttctccttctagccaaagactgttaggaattttaataaatattaaaggtaaaaagttaactataaagatgcctaacttaataagtagaaagagtgaggaaagatagaattgaaagcattagagaaatttgaggaaggtagatacataatttagccaattcctaaagctttagggattgtccccctgaaaattatgacacacctggctgggttacagtacacagcatgcagcgagtttctgatattagttctatgttttcactttcaatatttttactctgattaattttaaattagtttctaattaaaatttttctcattagtaagtctaaattattaaattacttctaattacttttgctatattaaatgatattttcatcacgaaagattttttttcctttaatgatgtaactacatggaatatacttaagcatctttatgtatataaattttttcccagccaaaaaaattgagatatattattttgtggcaaaaatattcagtttttccaccaactttgctaaaataactttattagatgaaagaaacatgatcttttaataaagttctataaaaagtcttatatttcaaaaaagaaccatgcaaaaatatttaaaaatacattagttctcaatacatacgagggatccctacttgttgttttcttattgctggaccaatgttcagcttcttatccttataattaagtttttcagcctaaaataaagaaaaaagaaattattttattattttagcactattatttataaaatcaataaggaaaaactagttagaaagaatttcaaaaattcagactataatattctttcaaagcagcaaggaatagtgggaaagagccgtcttcagactgaaatagatctgggtctgaccgcaattccccattttctccatttgtaatacagtcaatcctcattactcatggattctgtatttgtgaatttgcctacttgctaaaatttacttgtaatcctaaaattaatatttgtggcaattttgaggttattagtggacacgtgaagagcggcggaaaatttgagtagcctgatgcgcatgctcccagttgaggtcaaataaggcgatattctttcttcttgttccagtgctcatactctaagagagagctttctatttagtgccatgttttctccatttttgtgctttttgttggtgatttggctatttaaaatggcccccatgtgtattgttgaagtgctggctagcacaagaagactgtcataggcattatggagaatatatatattagatgtgcttaattcaagcatgaattatagtgctattggccatggcttcaatgttaatgaaccagtaatctgttatatatgatgcctttaaatggaaaaccatataaaacaaggttatatattgataggttgatggcaatattgtgaccagaggttcttgggaacattaccttgtacttcccctagaaagaggagttcagcatttgctaattcagtgttcctagcaatgttagagaacataactgccacaaataacaagaattgactgtatttgattttaataacatacaattcaaattctactttttttctaaaaaagttaaatgttatatttgccttaacttaaagttattacactgaattgctggctataggctttttttctgtgaatattcttagtttatataatgtttttcacaggagggaaatcatctcagataacctcactgttggaatccacatttgtagtgttttttaaacattcaaaatgctattaacacttcgcaaaagatatatccccaagttcttaatttaagtaaataaagcgaaacattatattacagtttcacaaccatacttgtagtgattttggaatttgctcttctgcagattaagtttcctagagaccaatgccaatcttaagatgcaaaccttttttaaaaagcagttgattattgtatttgaaccccgaaaagattagtttcaaatacaaaatttccagaaatgaagttaaatacaccaaaagatcatacctcttgtaaaattttttgtgcatcttcttgtgtttcaaaagtgacgaaaccatacctaaataaatgcattaattattactaattaatcattttcttagaatgttatattaattatattaaaatgtttaaaaattttgtttttaaatcatcggccactgtaggagtaggcatgtttctatgctgcactagcatgggaatcttagaagaatcattcacagcctaacactgtcacttttagtcaggaactaaaagaaaaaaaacccctgagatcttgaaacagcttcagctctcagctgtatgcaggaaagaaaagcacaagagattcatgctgttgcttaaaaattggggatgcaataaatttcaatccagagcaataatctccttttaaactaatagaagtttggctaagagaaatcaaagtagaaaaataactaaaaaatttaaaatttcaacacaataaaatttcttatattggtgaatgacaatgtaaatgtattatttaattattattattagcacatataactgataatgtaattattagtatattcccaaacaatatcaattaaaaatatgtacaacccagatttcacatctgtttttcatacataattaacttcaagcacaattcatataatgttgaagatacaaatacacataaatgatgtgctccatgtccaaaaagccacaataggtagagaaaaaagtaacaaaagaaagaaaaaatgtatctctcaaaacataattgctatttagataacttaagtaaactcttctgagtaatgctaaatatcttcactattttcttcaattcataattactggatcatatacaaagtttcttcttttaaacaaaggaatttctctttatctatttgcccaaacattaaaaagttaaggaattagttttacgctatttttttggtagaacacacacgccacccagtggaaaaggcataaaatacagtttacatttacatttccatgtatgttttccaatgattaaaaaatggtattaccaaaacatagcaaattctgttagtcaaacaaaagaggtaaatctcacttcaccttaatattgtttggcattctgaggaagtatctcatctgtttataaataacctttctgtagaatcccatctcttccagcatatccatctgtcgaatgttgtttctcaccaataccacctcaatgggtcccttttcttatgcctataaatatgtatgtctcgtctctctttcaagaaagtaaatacaatactttactgccttatctattttcttttaactttgcagtccaactccttaagtgagtgtactatgtaaactatctttttcctttctgaaatttggctttgtacacatagcattccactgaaacagctctatacacatttaaagacacagtctattactttcttctcaattttcattatcattgatatagcaattaaaaatcattctcactagaattatatttctcatactggtcccctaattaggtctctgaggcacaacctacagacatttcttggtgtcagctgttttcaaataaagctctctatggcctaaagcagggatacaattccaaaagaatctgattccttttgcttctcattcctcagctaatgtacatctgctacttacattaagtgcttgctgcctaccactgaatggtccctccacccatgcaagaataacttctcaacaaattaagaaatattacagtgtctcctccctccaaaatacacacacacacacacacacacacacaaggaaatcaaaaggtaggaggaaagaagagggcatgatggtctctgctggaaaatggaaccaaagtaaactggcgtacaaaacctagtcatccaatgaaaatagagttgctaattccatagacaatctatagtgatactaaccctttggatactccagctctgtcatttacaatcttcacttctttcacagacccatactgggaaaaaaattttcttaaatcactttcgtttgtctaatggcataaaaagaaaacgttaaaaagcatttttagttgataaaagatgaataattctcatgcttgctctggagacagaaaaagttatagataagatgcatgaaaaatgcctctcatcatcaaaacagtgcataaaccactaggtgattaaaatcaaggtaaatatcttgctttatgcaatagctatgttgttaaattaccatatgccaataaaaatgtaagctgaattattttaaaactacaaaactcactatttaaagaaatctttaaatgattcttgttctctagctggccagtttttaaaaagccaatttggattaggaatgctatttccatagtaagggtacaatactattttggctcttgtggctcagagacagtcatggcagtggaactaggttgtgttggcctacaccagtcattctattttaatcagtagtctcaggaactcctttcctaagtcagttttaggaaaggaatgtatttccaaaagtgcttgaactcaactgtgagaacaatggagtgactataagatttaaagttattagattccttatctgtactcaatatacatttcagctaaattcagacattgttttgataataaaataaaaattggaatcataattagatttaaagcatacaaggtgtctacaaagatggttttggcatgtctgtttttttaattgaaatagtctgataatagactcatatcaccttttctcagaatactgacactaaattcattgcaatttcatttcctggtttagctgtaactgtttgtctacaagagtaacttttctctagaaaaaaatttctttatatacactgcaaaaagacatgccttagtgcagagctatgccttttgagttcaactgccacctcactacttacatacactattggtttttagttggtaacataaagcctgctaagctgcataatgacaaatactgattcaatctaagaaaaactgaatgacttttatttcagttaacagaaaatgaaatcaatgctagaataagaattgttactagatatttgaatacaaattaattccaactattctctggtagaataatcactacctcaattttgtagctccacttctttagtgacaaagagacagtcaagaaaagtaagcattaagagggatagtctgtttgcttataaaaatgaaaggttaaaaagtctgtgactacttgctattaaagtaaatgatttccttgctggcctttatctgtggttttgaaaaaggtataagtatacaggaggaagccctagcaattaccttaaagctatggctgcattataacaaccgtctccaaagtgcatgctgtagctgatgggcttcagtaacctaaaataacctggccatacaaatgtttatatttattgataacttatttttaaaaacatgctaatctattgtaatataaatgaattcccaaattgaacatttctgccagctatcagtattttccacaaagaaaatctttttaaaaataaatattttataagaaataatttttcttactttatttttagtgaaacaatcatatacttgtttaagactcattgttttggcaaatacactaagtgtaacatttctcttgtgcaggaaaaaagaaattccacccaaattgtaacagattggttatatggaaatagttataaatgtcaaatatcacacctaatggcataaggaaggttttttttttgttgaaaatgataactctccctataatttctaatatgtaaaatagaagcttggaaatccttctatatatccatttgaaagtaagagtattccacttaaaatatctatgcatgcctttcttgtaggtgtttactcttacctcccctatgtgggctggggggcactgcacatcatgtcatgaactatgctttcttgaaacagtggaatggctgattacatgatataaatatattagtttttaaaaaacttttattttaagttcggggtacacgtgcagatttgttataaactcatcattggggtttgttgtatagattattttggcacccaggtactaagcctagtaccgaatagttatttttttttctgcttaaatatactacttttaagatgctttattctgacaaggacacaggacttttttggtgatcaaatcctaaattctaacatagaaagtgctttgcaaagaatagatgcctaggaggttgctcaggaatctgagataagagttggggtaaagaaatagtatttcataaaagtaagtttttaaaaaatagagtctcttttgaaaattataataatcaattattttggctattggaatattaggcaagaaagtataattagttctggtatggaagagtatggagctatgagacagaaaactaggcttctagtctcactctgtcactatgtggctagcagcccacagcaagtcagtgaggatcaatttctttatatctgacattgaacagtttttaatgctttatgtaacctacatgctggttgaaaagattctttataataagataattcaaaatctgttaatcattatgcaaatatgttattttatagttgcacaaagaaataatttctgagaaataaagacttctaatgaaaaaatacactttactgcatgcataaataggtaccttaaaatcaattcctcctacaaagatgcgattagggatcactgttccatatcttggggcacttgttgggttattcaaaggcacaggtgacacaggattaggggatggagataatgaatctgtttgcatctggtttgatgtttgctgtaaaataaaattcttttacactttttgcactgggtataatgcagtctgcttttgatgcagaccaaaaacatatatttttcaaaaagaagagtcatttaggcaaaatatagtattctaggctttacttttaatattataaaaattataattagagctaagagctttttaaggcaacagaactaggaaacacagaatctactccactatagagattttaaatattaaatatattacttaaaatgcttatattattatcaaacctattacttaattattaaggggaatattaaactcatgaacatgtttgagaaagagaaaacagtcccagcctgacacaatcaactacaccctggtgttgttaggagttggcctggcactcacagctaggctgtggtgttctcttgttaacagaacaccaacatcagacaaagtcaccctgtgactctgatggatcaagattaaaaacaagaccactccataatcatgtttgaatgctgacaaaaacaaaggcattgcccaaaccacaagaataaccaaacaaccctccattctggctgatatgagtgactgctccttctttatcagctatagttttagcctcgatccatttttctttccttttagataaaagttaacacatccaatcatagaattactaccatttcctgacgctatacattccagagtaaagccctacttccttaaaccctctctagaaattgctcaacagaagcctatatcctgtaagttctaacaccttctgattgagaggccccatggtttatgttttcccttgtttgaacaattaacagacccaactttactaaatgacgcatgtgttcctggtggtctttaactaatggtcatcgacaagttaataaactctaacattcacattcaccattttcagcctgaaagtcaaaattttaaatgcacttgtcaatttgaagattggactgattttgttaaaaaattatatacttgtagctcataaatgtttattccaaagaattagctcagtacatatccacatgttcacaattctaagttagaggacataatttaaattttaataaatatatataaatgtataagcctttgcagaatggtaagataatagacttttaaggtataactgaaaaaaaacccaagacttgagaatcacattgaagagaaaccaattcaagaactggtgaattattttccatctggaaacactaaacacacttctgagacaaaccccataatatcctaaagacaaaccccataatatcctaaatgtgtgcttcaaaaaacttgaagtaaactgggtgttgtggcttgtgcctgtaatcccagctgcttgggaggctgaggcaggaggattgcttgagatcaggagttcgagaccagcctgggcaacaaagaaagaccccatctcaaaaagaaagaaaaagaaaataacaaaagcttgaagttcataattccaattctctgagaaacaaactcatgaaaatgaatctccagctcaggtaataaagttgttctttttcaaatttgttctgctctttcttctctggccaatacaatcacaatccctaaattaatctttgcaagatgtacagagaaatgactagggcaggagtggcaattgggctataggctggaccttatgggctctcttccccatccagccttaaggaagtatgtactcctaataagggaatatgtaaatacttcttttaaaacacagaaaagccaccacatttaataattactatgttgtagtttccaatgaaagaaactgggaatctaatcttaacagctttctctctgggcacttggaggttatttgtgacttcagtcacttcgctcagtaggatataatgctcagaatgggtaattctggaatgcttagtatttttcaactatggattttgtattgctagagataatataacagctctagtagatgtaatcttgtctttctgcccatttgtttacagtgtcaaaattacctatttgctaaatttaaaaaatcattcttcatgaaattctcttattgaaaataagatgtactaatatgttcgcaagtttaagtaaaagacaaaccccattatatttcattgagagaaggatgaaatgaacggaagtaaacagtgctttatttccaatctcgagaaactaaaggatactccctgagaaaagaaaaacaacctttcacactcaattcacttcattctcctccactctctaaggctctattgtgggctcgctctgcttaagttttctccctcatcattttctaacatacgatatagtttacttagtatgtttattatctgtctccactattatgtaatgcaccagggcagaagttttgcttttttcatggcagcatctaaagtactgacagtacacagcaggtgctcaataaatatctgttgaatgactaaaagtgaatcatttcttcaggagagacctgctcatgatatgccaaataggctgaaggctaaagaatacagtataacagcagtctaatacatatatatatatatatatatatatatatatatatatatatatatatatatatatatatttgagacagtcttgctctgtcgccaggctggagtgcagtggcgtgatttcggctcactgcaacctccgcctccctggttcaagagattctcctgcctcagcctcctgagtagctgagactacaggtgcgcaccaccacgcccagctaatttttttgtattagtagagatgggttttcaccattttggccaggatggtctcgatctcctgacctcgtgatccgcccaccttggcctcccaaagtgctgggattacaggcgggagccatcgcgccaggcctacaaaatattttaatgttagcaatagcaaggctcaggtggaggcaacatctaagttcattataaacaattagcgatgcattgagttaaacaacaaagaaagcctgaaattccactagcaataattccgcatgtgttacggaaacacctagatggggactgttgccgggtttgaaggctcctccgtttgctaaaacttccagcactagagagtttattaaactactcctccaaagcaatgtgccctcactggcccctccccttgagaatcaacctcgagatctagcatctattttgcaaacgaagacagcaggaacgggcgggctaaccgtcgcagtcactgcctcggcgctcctccccctccaaggccagcaagttgcggcactgggggaaatggccgcggcgacaacttcctcgagttctctcgggtcatcgtgaacttgggcaccgaaacgaggatccaccccctccccaccaaagtgcgggagggaaaagaaggctagccagcgagaaattttgccccacaaatccgccagcagcagtggcgggaagcctcaacggcagcgaccccgccgctggcctcgtgcgcagctggtccccaccctcgcgcggcgctccctgattggctgctggcggcgggacggggcggggcgggatggcacgttgccgctgcgcctcgggcctgtgcgggcagtcctccttcacttccccaagtccaccctgactggcttgggtgcacagccagggctagagtgtccgggtcccgcctgggccacaggcgggccctgccaggtctctcagaccttccggtcctcgctgaccagtcggggagtggaggcgtcgaccgccctggcaactcctcgccttgggcggctgggtcgagttcggccgcagggagcgtcaaagacgctgcctagcccaatttcggcgggaaagcggtttacctgctcggacttcgctgggtgcctggcagcccgccgcctcccgaaacatccacgcctgaggtcccctggcccgtctacacccagtccaggccccgtggcggcgcctttctgacccccatgacacagccagacgaggtctgcgggcgggtggctcctggcagcggtcgatggggcacctggccacgtttcttcccaaccagatagcgagcgtttggggccttcacctcgcccctccaagccctcagggacaggctccacgctgctccttctccccgctatcccgcgccctggggccctgatcgccgtactcaccggcccggactcggtttccatcttcctctctgctcttcagagacgcggggtagggaaaagaagcctaaagtttgaaaccaccttcacgccaaggcagcagcgctgcttgtcctgcctgggactctcgccccctggcggcgagggtggctgtggcagctgcagggaagcaggctcggaccccggccctgaacctgccacctggcgggtggggagaagcggactgcgtcgcctc

SEQ ID NO: 2611 - DNA, 50061 bp, Homo sapiens
cgcacccgcaccggcgcgccggccgtcggtcacgtggcctccggccagggcttgcgaagccggaagtgtcctgagtctcgaggaggccgcgggagcccgccggcggtggcgcggcggagacccggctgggtaagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctggggtgtgtgtcgggtggccgtagccggtggaatggtcgcgcgggccctgttacctgcatccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgtattgatttttcagaggattaaaaagagacgtttccttagagttttagtgatgttcagtccgcagaggttgactcacaccggaaattagaagcataagatgttttaaatatatgccgatgaaatacgaattcccagacatttccttgctcctcgtctacctggcttatgggtttaatttgtaatctctatcccaagtattcttagtaggtggcctcaaaacaactcccaagtaattgccaaatgtataaccaaagactggtcttttccactctgaaaccccagtgtatgaatcacataggggcagagtttagaaatcctggaactttgtccataggccatgtcgtcaaacctgttttcatccctcaacaaatagtaactttcgttttggacggtgtaaggaagtaggctgaagacggcatcatcagcaacatagttgttgagtgtctgcttatatgcttgtcaaaaatttgggaagatttatatggcaagcacgttgtgggtgtgctgagtcatgttttaacatgttattgtggagttattggaagataatttcaaaagacatttcccctgaccactattgtgattactgttaaatagaaaccatagttttgtatttgcatagagaacagatatcttagctgataaatatttttcttattatcctgaaggtacatacatataggtacctaatggtactatttgccatttacagttacattgattagggaaggtttttcgttagatagttgagacgtttgttattgtatcgtgagtgaaatgtaatgactggcaaatgtgtattccttatttgtgaaaagggaatcttatttttattgcttatttcctatagtcgtatataaagtttatctaaattagatgggtagtaaaattatataaaaatatcctactatatcagtgattggtaaaattgagacccctgaccattctgcattttcctaacccagcttggggatattggtggtcattaattcatcacagaatacctagtctagcatactactttttgctttaacttactgtggagggatattaaaatccatgttttaatgacaatacagcaggtttaagggggcatggtgggactagtgtttatgttatgttagcatacatcaattttagtccagtgtggagcttggatactttgtataccttgatagatccatagcttttcagtattaaagacttgataatacaggctacttggtacgtttatatatttatacttggaggttggagaaactatccttaaattaattccagaagagttcgtaacttttcaggaataataatttttgcacctttcctttatgtttgtcaggttctgtgtagattgtgtagataaaattttagcttatgggaatattatgcagtgacaacatttgtcttcattagtgtttctctgctctgaaggaaacaaagtaatttttcctatatttgttatattttacattattacttttctttattttaaaacaccttaaattatgtcataaattaatctttcaaaacatttgaaggaggtaagtaacaatatcactctcatcaacaaagacaaaattagaagagaaataggtgttgtttttgtttgtttttgtttctttttgagatggagtctcgctctgtcaccctggctggagtgcagtggtgcgatctcagctcactgcaacctctgcctcctggtttcaagcaattcttctgcctcagcctcccgagtagctgggattacaggcatgcgccaccacgcctggctaatttttttgtatttttagtagaggcggggtttctccatattggccaggctggtctcgaactcctgaccttgtgatccgcccgcctcggcctcccagagtgctgggattacaggcatgggccactgcacccggctgagaaatagatgtttctttcagccctgtgttaagtgaattaaattgaatgtatgtcattggttaatgttttttttttcaaagctcatacagcattttagccttgaatattgctagaaactcagatcttttttttttttttttttttttgagacggagtctcgctgtgtcacccagcctggagtgcagtggcgcgatctcggctcactgcaagctccgcctcccgggttcccgccattctcctgcgtcagcctcccgagtagctgggtctacaggcgcccgccaccatgcccggctaatttttttgtatttttagtagagacggggtttcaccatgttatccaggatggtctcaatctcctgacctcgtgatccgcccgcctcggcctcccaaagtgctgggattacaggcgtgagccaccgcgcccggccaattttttttttttcttttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaactttgaagaccttttatcactgtatgtattttgttctaagatgcatgttgacactaaagtgtgtgacttggtgattttgatccctttgtctgaagaaattgttttaatgattttcgtggtcatttaaggcatagctgtgtcaggcagtgaacatatctacccagtggtggcacaggttaagtgttagtgagtggaggaaaacagattggttgaaaatggactgggaaagattagtgttgtgccttttgatgctttccccagcccagctccctaatggtagagtgatttcactgacagaagttcagtgtaatgagttgaggtagcatttgatgtggcattttggttggtagggaggcagatgtgtattgggaggggaactcacaggtgtttctgataggctctggtaagggtaagtgcccctactaaaacagcatcctacaaagtagattggagtaaaatgagattctcaacaaggagcccaggttgaaaagaccatattttggtataaggtaatcagaacctggtagtggaagtgggaataaaataaaaagattattcccagaggcacttcaagaaccaaaaaggggccgggcgcggtggctcacgcctgtaatcccagcactttgggaggccgaggcaggcggatcacgaggtcaggagatcgagaccatcctggctaacacggtgaaaccccgtctctactaaaaatacaaaaaaaattagccaggcgtggtggcgggcgcctgtagtcccagctactcgggaggctgaggcaggagaatggtgtgaacccaggaggcggaggctgcagtgagccaagatagcaccactgcactccagcctgggtgacagagcaagactcaattaaaaaaaaaaaaaaaaggattttgtttagattcaatgtggaggatgaaatttaaaatagttaaaataatttaaaattaagaaattgaagataattaaactttctattctgggaaaaagctggagaaatggagtctgagaaagaagctggaaaaatggagtacaaagttcatttataatacaaataataactaatttttcagtgctatgaatttgtttcgagctaaatgatgtttggagcttcctaaatccttattttcagaaacagggccctaaacgttttagtagagaggaattgcttcctcttttcctgtattcttgagactaccagtcagttctgtcagtgacgatgagataagcgtacatgggggaggggctgtttcctctggggagagaatattgactataaacaccctttatggctcatagagaatgaatcagaagtaccatacagacaacttttagctttcctccccctgtatctagaattatccacaagctctggattcttattcagattacttgcgatcaatcctgggtactccgtcctagaaattgcttttgttttatgccaaggagaaaatgactagtgcctcagaatttagcattgagaacacgtctgatcatcttatcttcctgtagtccaaattaacaaacttttaataatcacttggtatgtgtcaggcactatggcagacctagtgaatattactatagctaatgtgcggttagctatactgcacattaactggacacagtttcgagtttagtagcaagattgattagaaaggaagtaaagtggaagctgatgggatgagagatagtcaatagtgatagagactggatgagacatattgaaagggcctggcactagaagatacgtcacatatcctgctcctctttccttacttagatactcagtgttcttcatgtaagtgactacacatagtatgcactctgtaaatgtttgctgaatgaaagaataagtgaatgaatgaggactgattagactaccccaagacaacctaaagttctccaaaggaaacaaatatgtactttacccattatagtgtggaaatctaaaatgagaatttcagaagtataagaattaattaaaagattgtgaagtcgagcatggtggctcacgcctgtaatcccagcactttcggaggccaaggcaggtaggttgcttgtgcccaggagttttgagaccagcctgggcaacatggcaaaaccctgtctctactaaacacacacacacacacacacacacacacacacacatacacacacgaaaaagattgccaaggcccagtctagtatttagtccccaacagttttcctagggatgtgctttgagaaaccatatttgttcttaatgatggcagttgcaactgtttaggactatatcctacaaaaaatcctgcttccctttaactatttaaaggatttttaccatgatattagcccttttatattatttcttagaatgaccaaattcttacatttattacttgttattcaaagtatattacctacttaatctgttttttattaaattgcttttagttactaaagtatgagtgtgggtgtgtgtatatgtgtgtgattaccatggtgaagtttaagggaagagacttgaaggatgtgttgatctgcacatatggatatatacatatatatatatatatatatggatctctattatttgtatacactttgacttagtgaataatagatgactgtgtaggtgaataaagggaaaatagtacgtttccacctggatcccgataatctcacaggcatgatgtagtctacacaagtttggaaaataatgaccatgaggtcagtgggtatattgcaaaattgtattattttccctgcttgctcctctgttaggattctcctagttttagactgagtttgaggcctgtctcagcttaagaaaaatcactctgttgggtgatgcatagatttggcagtgtcttaacccttgctgaactgagggaaaaacagtgaaactgaactgtacttaaattcttctcttttcatatgtgtgaaaatggtcattggctctttgatctttcatcttcctctagaaagaatatatatcaatttgtgtattttgcatgaccagggtgaggggaatcacataggattatgaagcagttaaatggccttaagaaaaggatcatgcgattctggagtgagagaggagggtgatggctctaagtggtgaatctgaggaaagtataaagagggctccaaagcaggaacagtacagaggtcctgacagagagccatgaaatgtctttagccatgaaatgtgcttgaaccccaagctcaaagagaaaaggattttcctgcttgctctagggaagttcaaccttggataaatgggggaaaatgtaaggctaaactcaagatctggactggccacgagggagaggcttgctcattagagtgattggaaggaagtgagagggtctgaaagacaatcttaaaggaaggttaataagaagaacatataaatatgatgtttgcctgaaatgtaagcatgtgttttgaacctctaagattccctcccaactacagctgtgctttgtaattttgtgtgtgatgtaggtcatgaaagagtgagagtgggatgctgtggtacatcagtagagaagaagaaataaatgcctttactcctctagagagggtctgtgaaggaacagcctgccctggtcatctaggtagaattgcagaaagtaacccagggcagcaggggcagaaaccaaccaggaagtctactttagcctcgctctgcaactcctgctttccccactcccctcccccacgttgtcctagctacaaaataattctgaaaagttaactgtattactttgatattcttaataaaaatctcataggtggaatatagtgttcagtctctctctcctgctttgattagtttaaaattattaggccttggagaagcccttatgagtttcactttctatttcgtctttaaaagatgattttgcttttgatactattatggcttttatcttctgatgtgtgactatttttgcccctactgtatcctcatgaaaggtttatttataatatgaaagaaaatatccatttctgaattccaaaaggtgtaatttgaaagaaatgttgagcagttaattgattcattttaactttttagaaaagtcaaaagtcctcatacagattccctgtgcctaaaagatgcatgatgttctgtaagaaaataagttgcaatagcgagttctaatgctaccttttaatctcttttacaatattatgaataaataaaacatttctctctcttttttaaagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggaggtaagtagtaaaacttcaatcttatatttattgtagttacgagtcaagaaatagaacctaatattaaaaaatggattttttaaaaaactgttgaaaattagggtttgtacaaccaaatactttatcctaaaggattcttgaatatatagaacaatagaaataaaatatcataaaaatggaatcagaaacagtagtgtaagaaataaaagggggcggccggctgcggctgggtgcagtggctcacacctataatcccagcactttgggagaccgaggcaggtagatcatgcggtcaagagattgagaccagcctggccaatgtggtgaaaccccgtctctactaaaaatacaaaaattagcttggcatggtggtgcgcacctgtagttccagctacttgggaggctgagacaggagaattgcttgaacccaggaggcagaggtcacagtgagctgagatcgcaccactgcactccagcctggcaacagagggagactccatctcaaaaaaaaaaaaaaaaaaagaaaggatcatttgagctcaggaattcaagaacagcctgggcaacatggcaaaaccctgtctctgtaaaaaatacaaaaatttgccatgcatggaggtgtacgcctgtagttccagctactcaggaggctgaagtgggaggatcacctgagcctgagaggtcaaggctatggtgaaccatattgtgccactgtactctagcatgggtgatggagtgagaccctgtctcaaaaaaaaaaagaaagaaggaaataaaagggtattgaatatggttaccagtattattactagaaaaagaaaggtaacaagttaaatctaataattataaagagaaaaaataattataaaaagaaaaaatcgaactttaaaaaaataaaaattttgtatttcatgaataaaaatttcaagagtcctacagtttaagatatgaagtccaattataaaagaattgatttttttaaggggaaatagtggaattaagaatgtcattaggaaaagtaatctagaaataatggaaatagaaattattttaatccctttaaacatgagcaatcaataaaatctttgggaaaaaatgtagtttatactctttatccgagtgattttatttttagtgattatttcttaggaagtaatcagaaatataattttatgcatgaagatgttaattggcatcctgtttataataaagaatggttaaataagttgaataaattagaatgtgtggcagatagttacctggaattagccaaactcaagattaagagcatagccttccacactgccaagtctgctcaagacttttgataccaattgcaaaggagtttggcaaactgcacagagagaacagttcccacaagattaccctcacatcatcccagccggctacaaatgtgggggttgcccatgacactcaggtttggtaatttgctggaatgtagaaatgactcacaaaactgaggagagtgctatacttataattacagttttattgtagcaaaaagatagaaattagaaccagccagaggaagagacacaaagcgtggaatgtgggagggttccaatcttgaagcttctttgtcctgagggacacattactctctcagcattgatgtatgacagtatgcatgaagtattgccagtcagggaagctcacccaagcctttggtgtccagggtttttactgaggctggatcatttattgcctgtattgctgacctttagtccccagctccttccagaagtttggggtaattcctttagtctccattaagcccccatcctaaatcatgctgtgagactctccagtggccaaagcccccagaggaacaaagacagaagtcttgttctttcagataggacattttaggggccagagatcactgtccagtagccaagggcaaagcctgacttctctttgggtaaagttaattttttaccacacaatagttaagtggtaatgaaaagagatatttaccaaaattttaatcttcttggaacaccttatatatgatgttatgtgagaagaatcaggattaaaaatatatatgtagtatgatcttaacatatacagtgtaatatgcaaacagcattatgtatctatgacattatttcatccatagaaaaaagactgaaagaaaatacgccaaaatattaattcattatctccaggtaatggaattatgtatacttcccaaattttcaacaatcaacatacattatcatttaaaagcaacagttttttttttctactatgattatttctctctcttttttgaaatgactgccagagagtaatttaaaatattttataaaagtgttttggagatatgtagaaaaaaattagaaaagaaacaaaggataaaaagttggagatgaatagtagattttaagactcattcagattttcagattctgaaattgtcatgcatcttataatcattgtgtatatataatttgatggtatttctttttccccgtaatgctgttattaaattgatgaagcattataatcaatggtacattaaaattaaggtttaaaacaaatcagcatctcagatgcaaatgagcagactggagctttgctgcaagagggaccactcagctgttctgctacccatttatttttaaggataggactccattccttgaagtaacagtagtcatcataagaaaaatttcattttaagaggttagaagagctgttgtcctaaatgtactgttatacataagaaattcagcactggtgtggtgactcacgcctgtaatcccagcactttgggaggccgaggtgggcggatcacgaggtcaggagatcgagaccatcctggctaacatggtgaaaccccgtctctactaaaaatacaaaaaaattagccgggtgtggtggcactcgtctgtagtcccatctattcaggaggctgaggcaggagaatggagagtggcgtgaaccctgggaggcagagcttccagtgagccgagatcgcgccactgcgctccagcctgggtgacaaagcgagactttgtctcaaaaaaaaaaaaaagaaggaaagaaagaaattcaagtgactgggtgtggtagctcatgcttgcaatcccagcactttgggaggttgaggcaggcagattgcttgagcccagaaattcgagactagcctgggcaacatagtgagaccccgtctctacaaaataatagaaaaattagccaggcatggtggagcatgcccgtaatcccagctacttgggagctgaggcaggagaatcacttgaaccttggaggtggaggttgcagtgagccaagatcgtaccattgcactccagtctgggtgacagagcaagactctgtctcaaaaaaaaaaaaaaagaaaggaatttaagatgattttaacaaaaccattgtaacattgtaccaatgattttgtagttcagatttagctactttttactgtggtttgtcttcaaaaacaaatccaacttcttcacctaataggaatttggaaaatgttagttttttttttttgttttttttttttgagatggagtctcgctctgtcaccaggctggactgcagtagtgcaatctcggctcactgcaacttccgcctcccaggttcaagtgattctcctgcctcagtctcctgagtagctgggactagaggcatgtgccaccacactcagctaatttttgtatttttagtagagaccgggtttcagcatgttggccaggatagtctcaatctcttgacctcgtgatccgcccacctcagcctcccaaagtgctgggattacaggcgtgagccaccacacccggccggaagatattaattcttatatgtgtatgttcaacagatactgaatctcaggtgaagcaaagtgccttcatcattgtagcaaatcctacatttaaatgaaatcagataagtactggcatataatcaaaatttattttttatgttgattcccaatcaatgattttttttttcagacaacaacaagacataaagtacttattatggaattttgtccatgtgggagtttatacactgttttagaagaaccttctaatgcctatggactaccagaatctgaattcttaattgttttgcgagatgtgggtatgtttgtttatttatatgatatcatttgtatataaaatttaataacagaatttttaaaaaatatcttccattcaaaactgaagacctttatgcaatgcttcattagatatgacaccaaaagcacaaataccagaaatacataaattggatttcatcagcattaaacatttttgggcctcagaggacatcaggtaagtgaaaagacagcccatagaatgagaaaaaaatgtttgtaaatcatacacctgacaagggatttttatccagacaactcaacaataaaaagccaaataacccaatttaaaaatgggcaaaggattcgcatagacatttctccaaagaagatacacaagtggctaacaagtacataaaaaaaagctcaacattaattaattaataaccgacatcattggttattagggaaatgctcatcaaaaccacaatgaaataccactttataccaatgaaaatgactaatatcaaaaagacaaacagggccaaccatggtggctcacgcctgtaatcccagcactttaggaagtggaggccggcagattgcttgagtccaggagttcaagatcagcctgagcaacacagtgagcccctgtctctacaaaaaataaaataaaaaatagccaagcatggtggcatgcacttgtagacagctactcaggaggctgtggtgggaggatcacttgagcccaggagattgaggctgctgtgagccttgattgtgccactgcacttcagcctgggcaacaaagcaagactatctcaaaaaaaaaaaaaaaaaaaaaacaagtgttggcaagaatatggagaattggaaccctgatacattgctggtaggattataaaatgatacagccattctagaaaacagtctagagttcctcaaaaagttaaatatagaattatttaacttttgaccaaatgacccagcagttccactgctacgtatataccccaaagaattaacatatccatataaaaacttgtactccagtgtacttagcagcattattcataatagcaaaaaaaaaaaaagatgaaaacagcccaaatgtccatcaactgatgaacagataaacaaaaatgtggtgtgtctatacaatggaatattgtttgtttacaaaaagatatgaagtagttatatatgctacaacatggatgaacttgaaaacattatgctaagtgaaagaagccagacacaaaggctgcaatattatatgattccatttatatgaaatgtcaagaataggcaaatccatagagacagaaaacagattagtggtttctgggggatcaggagaagatggagttgggtatgagttgtctttttggtgtgacaaaagtattctgaaatcagtggtgatggttgtataactctgtgaccatactaaaaatgactgaattgtacactttaaaaagatgaatgttatgtttgaattatatctcagtgaacctattttttaaaaaaaatactgcaatcaaaggaaataacatcttaagagaaatgaatcaaatatttgaggaatgggaaaaagtcaagtgataaggtaaaaggttggtgggaattcttgaacttgtcactggaagcagagtgattatttaggtgaggatacaatgagagagaaacaatattactagtatgctacagcctgtttaatcaaatagaaattatagatatgatgtcttcctaagtgtattggtagtcctgagttttaataattatacattgatacccctaaaccttttacatattttgaatttgaacattcatctatcagccctcaagcaaatgtataaagttatcactcagtgacactgtcagttagacaaaatagcttaatttcagcaaagtagacaactttgcccttaagaaaaaagaagaaaaaatgggctttttggaatagtgccaagcatatgagaatacatttttacagaaacaagtttgacactttgctgtttttctgtttcttttttgctgttttacatattgagttcagtttacttttagggaattttttttcccaagataaagaaatgtaaaactctggtgaaagattgatatcttttttgggaatctttattatttttatgtttaaacagatcacccacatatatataaccaaagtaattcaagaaatcatatgcttaagactgttttgttacattttcctggtagtacttaagagacactggatttttccttagaccacattaatttttatcattctaaaacttcttataactaaaacataacatcttttatatatatatatttattatctattctttgagtaaaattactttgaaccaaattatggaaaaatttatattaagtttgggtgactatatcaatgaatttgagacatgcacacatacacgtaaatatctacattatgacttcttttgttttatattgttgaagtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttggtaagtcatgtatcactaatattttcatttaaagaagcttgatatattgtaattataattgggtaattggtcagccaattcactataaaatgtcatttttatgacaaaaattaaattttctattctaatgaatatgtgcaacatgggaattaggtactcgcttccaagggtgctgttatttttctattaaaaattcttggaagttttgtagcacccttaaattctttagttttactgatgctatggatctaaattaaaagggtctgttttttgatgagcagtcagcatattacaagcttgttataatactgttttttatatattcattatatttatgaaacagataattctatttgggggagttggttattgaatgacgaaaaggaccattgttagaaacacacacacacaaaatgcccctgagaagatctaacttgaaattttagaaagctagaaaagctctgtagttgaaaaagtttatgtaggtgtgtttttgtaaagtcagtaaatatttgaaatacttaagaaaatatacttaaaagtaaatacttttaacatgtaatcaggaagtttaatatatatagctcactgattattcatggctttgggttttgtcttaaaagtcatagaatcaatgacttttttgcatttggattgtgctgttgtaattttataagatgaaagatatctaccacaccctgtagctttattcagattattctaagtctggcatgaactaaatgtcttaaattgttatcctaacaattggtaacctcaaattgatctgtagatatatgtgatgatcttttagataagagtacctaagaatgggtcagacacagtggctcatgcctataattccaacactttgggaggctgaggattgcttgagcccaggagttcaagaccagtctgggcacaatgacaagaccccatctctgcaaaaaattacaaaattagccaggcatggtggcgcacatctgtacacccagctactcaggaggctgaggcagaaggatcccttgagcccaggaatttgaggcaacagtaagctatgattgcaccactgcaatctggcctgggctataaagcaagactctgtctcttaattttttaaaaaaaggtacctggcccaggcatggtggctcatgcctgtaatcccagcactttgggaggccgaggtgggcagatcacaagttcaggagtttgagaccagcctgagcaacatggtgaaaccccatctctactaaaaatacaaaaattagctgggtgtggtggcgtgtgcctgtaatctcagctactttgggaggttgaggcagaattgtctgaacctgggaggtggaggtttcagtgagccgagatcgtgccactgcactccagcctgggtgacagagcgagactccgtctcagaaaaaaaaaaaaaaagtacctaaaaatggattttattcattcattgcacaaatatttatgaagtgcctactatataccagatactgttctaggtgctcagacttctatggtgaactacatacacagtattcctgctcttatggagcccacgttctggtagggaaaaaagacaattaacaagtaagtaaagtaaattcagatcattaaagtttagcaaagacaataaattaaggtaataagataaagagtgactagcaggagaaacatagcctgggaaagcctcctttgaggactaaatgaactgacactgaaatgataaaaagaagcaagccaggcacagcgttctgactgctgttctgtgccgttccctggccctgtgaaagctacctccccctgcagaaaagaaactcaaccaccagtcctcatactcctcggcagttccctccatctctgcttgctgagaacctactgcatcagtctagcctactgcatcagtctgaaccctactgcatcagtctagcctcctctcccctacaacctgtgttgttgagggcccaggatgcctatggggtcctctggctgtctgagttgtgacgtatgagctgctttgtgatacagtgaactccctgtcattgtggatctggagaatgtgtcatagaacctagatagcagagggaagtacagttgtaatgaattcaccttcaagcttcctgagactcttggctggaacagaggcaggactcagacgtttctggcgagtggaatcaggcttcatatcctgaattctccacgtgaatgtaagctccacaaaaccagggactttcatcttagcctaccgagaacaccaagcagaattagacaagaagaaatcacccccttcctgctcctttctccgtcctacatgacatttgtgcttttgctattatccttttgtctcttcctgggcctcaacatgtgactgagtcaacacacatcttcattctcatttctctgttggtggtcttctcagttatatttggctagaccatgctttctgcttctagaagcaacactgctgaattcacaccagagctttggtacaaggcaacttcctgattccttcactttccccagttcagacattccccttgtcttttctcttagagcagtgagcctccaataaatagctcaaggccatgttcttccagactgcctcctttccagtagcaagctcaagcgcgtgtccttcaaattcaatgattagataagataacttgttcaaaaattcaatttctctctttctctttctctcacccagtactttttttttttccccaaccccactttctgtaagaacagcctatttctaaaagctagttcaccaggcccagctccttgtctctggagcccacacctgtcatagccaaagccacagtagatgaatgctcaggacactactgttcccaggagggcactgcttgccaaggtttactgctctaagaatgttcttgggcttcagtctggttccatcaggcccagagaaaacagcagctgtaaaggcctggagacaagaatgacctcaggagttggagaaacagaaaagatggcagttttactggaatttagtgagtaaagaggcaagtggaaggacttagaattaaagaagtgatcagggggctagccagatcagacaggctagtagtttaaaccctgtcagaccaatacccccttgttataataaatattttgtagtgttcccttcagtatcttgaaatgaaattcctagataatattataaacctgcacacctaattaaaatagcatatcttaataatgtaaaggaacatattttataataaaataatagatatttaatatgtaaaaatttagaaacagcttcatgagcaaacaagtagtgatatatgcttgcagctatatgtaatactactttgaatacaagtgcagtgataactcatgttgtattagtgaatcacatcacaaatggtagtattgttattgacatgattttccaaagtagtgaacaatttttggtaaagtttctaactaaaagtaaatttaaatatagttacattcttggaaaagctgtacaaaaatactttgttatatataaaatggagttcgaaatagatttctcacttgcacaagtatctggcagaatattccaaagtcattcaggctatatataggaggatcatttttcagaactgtcacatacactgcagtatgtccttcagtgtctggtctccgccttttccaatcatgataatcactgtaacaagcaaacagcagtcctgtaccagccttcatgaggttgctcccccaataccaactattaatctttcatgtaacctcctgggaacacagtttagcttttgcctctaagacttttaacaggaagagcaaaacattaaataaattaattccaagtctgtgctgtactctaggctgaaatttaaccccattctatttatttcctatttcagaatgggaaatattcaaatacagtgcaccagaatgagataaataatagtctaaggctcagcagcctagctatattctacatttaactggaaacttccctcgttttgaagctcccaggaactacaacccatatgttaaattctctctcttttgtatgttaaagtccaaagaaaacattcttctactgttttttgtttttgttgttgttgttattgtgacagagtctcaatctgttgcccaggctggagtgcagtggcataatctcagctcactcaagctccacctcccaggttcaggtgattcttatgtgccagcctcctagatagctggggttacaggtgcacaccaccacacctggctaatatttttgtgtctatatatatatatgtatacttttgagacagagtctcactctgttgcccaggctggagtgtagtggtgccatcctagctcactgcaacctccacctcctggattcaagcaattctcctgcctcagcttcccaagtagctgggattacaggtgtgtgccactacacccagctaatttttgtatttttagtagagatgaggtttcaccatgttggccaggctagtctcaaactcctgacctcaagcgatccacccaccttggcctcccaaagtgctgggattacaggatgtgagccaccacaccctgtctcttctactgtttttaatatgatggatatcatctcagtaatataatcctgaaaaccttggagtagctttatccttatgctcttcttccagatgcaatagcccaggcccagtaacaccaagccagtaacacatcaggacagagccagtgggcacaaatgtatcagaccagcatgtgtcaagccaccccaagttaatcactcccagggaatagcttccagctgtaccaattaggcagtatattattgcaccgtgtgaggaggtccgtctttgtctccttctggaatcactgtgtcccctcttcccaggaggctttatattccagaaggcatcagacatatccaggtacttttggcctcttcatgacaccatttacacactaagtaccagctgctaggtcaaaggtttggcaatcacttctttggacaataatcactttatgtgctgtgctacagaaccagcaaagccactgagatcccatatatctagtaggcatatgtttggacactcacgtcaatacccagttcttatacttgtctgcattctgatttctcattaaaatgtgtttctcaaaagagtctttttcccacccccatctccagcacccccccaccaccccgaccctcagaaatcagagattgtgatcctttgggagtgagagtcacagattgcatcatttagaagcccctcccagcagcatttcctacactggttcccagttccctgggccatagctaaatcctacaatgtcataaggaattgttttggtttgggatcatttaggtggtaactctactttggtccatacgtacacttttcaagatttatcttccaaaaatcttcaagttgcaagtgtataactttcatgaaggcagatggcaggaggccatgctgtgtgtgaccactggttattctctgcagaacaaaatgtccatcagaatatctgttaggttttgtgagctcctaaacaatttcttagaagctccatctgttctcagtgactatggtattagtgcagagtgtccaatcttttggcttccctgggctacactggaagaattgtcttgggccacatataaaatatgatagattatcttgggccacacataaaataatgatagctgatgagctattttaaaaaaatcacaaaaaacctcaatgttttaagaaagtttatgaatttgtgttgggccacattcaaagctgtcctgggctacatgtggcccacaggctgcaggttggacaagcttggtgtaatatgtcctatgtgtaaggacgtgtgtttaatgtcagtagatccccagtgaacccagtcaagttagtcctctgaattgattctagagaatttaatttcattaaattaaatgcacttaccctgacagattgcatttgagggataaggcaaagaaattaaggctgcctgataggtttcgggtgtgagcagctagatatgtggtggtattgtttacttaaagtttaggaggaaacaagtttaagtgggaagaccaagagtcaattttggatacgttaagtttgagctgccttttagatatcgagagaatagtaggatatatgaatctgaagctcagggcccaaggtagttttggaagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagatattaaagcatgtttgtaagcagaaagtaatgaatcagaacagagggaaacattgctgcattaaataagtgggataattacaagaattgatttctggaattggcaagatgatatgataggctctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaacccgggaagcagaggttgcagtgagccgagatcaagccactgcactccaccccatctcaaaaaaaagagaaaaaaataaaacggacacagattcaggtaggttgtatttggtaaagggcataagggagtgctggtctgattccttccatttccacattaaattatgaagcagggtcatcaaaactgaggatcaaaggaggtggtggaggtttgaggagggaggggaagatgtgaaatagtcttttcagattgggaaagtgaagttattaggaaaacaaaatagaatttctaagcattattgagtatccatttgtttgtataatgaaatgggtcacaggttcatgatttttttcttttttttttaatcttagcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtaagtggtttcccgatctaaaatcagagaagcatttaaaaaatgatttctgtcttggttcatcttattgttagtggtttatgctaataaaaattgatttaacaatcatttctgatattttaagctacctggtttttaaaaagaatgcagccttataaaagtttgcataattttatgtttaagatatttatgtttaaatatcttatatacacagtataaatggtattcagtctttggcccatcattaaaaatgtactgctttctagactttatttcagcacactgtttatttcactctgcatacttgtcagcactttcctcccatacaactgaaaaaaaatacatagttctgtggagtattagaatcattaccagatctaaaacaaacatcagtcttaccctaaagtgaactgattccttttaccatttaaaaaataacattttgggccaggcgtggtggctcacgcctgtaatcccagcactttgggaggctgagggaggaggatagcttgagcctaggagttccaagactagcctgagcaacagtgagaccctgtctctataaaaaaatacaaacattagccaggggtggtggtatgctcccatagtcccagctactcaggaggctgaggtggtaggatcacctgatcccaggagattgaggctgctgtgaactgtgattgcgccacggcactccagcctgggcgacagagtgagaccctgtctctaaataaataaatgaaagaaaattaaaaataacattttggcagtaatgtaacattaaacttttttttccagtgttgcagatttggaccagacacttgatatattttactagtataatgtatacacatttatgtattgtcacaatttttttttaatttccatttttattttagattcagagggtatgtgtgaaggtttagttaaaagggtatgttgtgtagtgctgaggtttggacttttgttgatcctatcacccagatagtgaacgtggtaccgaataagaagtgttcagcccttgtctccttccctccctacttttggagtcctcagtgtctgttgtttccatctttgtgtccatctttgatgcattaaataagtgggataattacaagaattgatttctgggattggcgagacaatatgatgggctccacagcacagatggaaaagttgtgaacgcaagatttagctctcatttataagtgagaacataacagtatttggttttttgtttctgcattagttcacttaggataaaggtctccagctgcatccatgttgctgcaaaggatatgatttcattcttttttatggctgcatagtattctacagtgtatgtgtaccacatttttgttatccagtctgccattgatgggaacctagattgattctatgtgtttgctatcgtgaatactgctgggataaacatacaagcgcatgtctttttaggtaggatgatttatttttctttggttatatacccagcaatgggattgctgggtcaaatgatagttctatttttagttatttgagaactccaagctgcttttcgtaggggctgaactaatttgcattcccaccaatagtgtataattattcccttttctccacaacctcaccagcatctgttacttttttttatttttttatagccattctgactggcgtgagatggtatctcattgcagttttgatttgcatctctttgatgattagtggttttttcatgtttgttggcagcttgcgtagtcttctttttttttttttttttttttttttgagatggagtctcgctctgttgcccaggctggagtgcagtggtgcgatctcagctcactgcaagctccgcctccctggttcacgctattctcctgcctcagcctcccgagtagctgagactacaggcacgtgccaccacacccggctaattttttgtattttttagtagagacggggtttcaccatgttagccaggatggtctcgatctcctgacctcgtgatccacccgcctcggcctcccagagtgctaggatcacaagtgtgagccaccacacccggcgcatagtcttcttttgaggagagtgtattcatgtcctttgctcactttttaatgggaatgtttgtttttttcttgttgattcgtttaagttccttatagattctggatgttagtcctttgtcaaatgcatagtttacaaataatttctcccattctataggttgtctgtttattctgttgagagttctttttgctgtgccaaagctctttagtttaattaagtctcctttgtctattttttattttgttgcatttgattttggggtattcatcctgaattatttgcctaagacaatgtatagaagagtatgtcctatattttcttctagaatttttgtagtttgaggtcttacatttaagtctttaattcatcttgagttaatttttgtatatggtaagaggtaggggtctagttttattctgcatatggttagctagttttcccagcaccatttttcgaatagggtatcctttcccccattgtttatttttgtcaactttgtcaaagatatgttggttgtagatgtatggctttattttaggagtctctattctgttccatcagtctgtgtatctgtttttgtaccagtaccatgctgttttggttaccgtagctctgcagtatagtttgaagtcaggtaatatgatgccttcagctttgttctttttgcttaagattgccttggctattcaggctctgtttttgttccatatgaatttagaatagttttttctaattctgtgaaaaataactgataatttgataagaatagcattgattctgtagattgctctgcgcagtatggatattttaatgatattgattcttccaacccatgcgcatggaatgcttttccatttgttgtgtcatttatgatttctttcagcggtgttagttcttgtagtcatctttcaactcctcagttaagtgtattcctaggtatttttgtgtctgtgtgtggctatggtaaatgggattgcgttcttgataaagtctcagctttgtccgtgtatagaaatgctactgattgttctacatttattttgtgtcctgagatttggctgaaattatttatcaggtctaggagtcttttggcaaaatctttagggttttctaggtttagaatcatactgtcagtgaagagagataatttgactacctgttttcctatttgaatgccttttatttttgtcttacctgattgctctggctgagacttctagtactatgttgaataggagtggtgagagtgggcatccttgtcttgtctcagttcttaaggggaattgcccattcagaatgatgttggctattggtttgtcatagatggctcttattattttgagatatgttccttctgtgcctagtttgttgagatgtattgccataattattatgaaataattactgtgtataaagtcattttttgtaagccaaggaagagatggatttctagatgtgaaattaattataaaaataatccataattgaccacacttctttttattttaaaagacattagtgaataaccttgtttcatgagaaggccagaccacatacacataaaactatgatgtgaagaatattgagtttagtgaatggataacaaccactgacagcctaacctgtccaaccattcttttaggtcttaacatatttctcagacctttatatatttggccctatcttttgttttgtttgttttgtttttttgagacagtttcactctgttgcccatgcaggagtgcggtggcctgatctcagctcactgcaacctgtacctgccaggttcaagcaattctcctgcctcagcctcccgaatagctgggattacaggcacccaccaccatgcccggctaatttttgtatttttagtaaagatgggtttcaccacgttgcccaggctggtcttgaactcctggcctcaagtgatctgccccccgccttggtctcccaaagtgctggcattacaggcatgagccaccgcacccagcctggccctatcttttatgaagcaaacctgacttaaagtaataatcacaactgtaaaaagacaattatctaatctcttctcaaaaaattgagggagaagcatgtttttccttttgttggttggaggaagtaaaacaaattcagatggtacaatgactttttctataacttgggtatttaagtgttttccagcaaggacagtgtacatatttatgggaagaagacacctatttaactgtactgatgattttggcatagcatcctattgagcctgctttatgtcattgcccttttaatgaaatctcttcattaataaaaactgataatttgtgtttttctcattacacataaattgtgcctaacagttaatcatacttttttcatcatagatagtatcagcctttaaagcaatgtcagcatttcttgctgccctaaaaatggtttaaataaaagtgtgtgctgctcactaataaaggaaacatgtgactcataagcagctaggaatacctgatgattttatctgacacccttgtgggcagatataccattagaagaattttattttattagcacagaaactcaactttttatgaacattgatgctaaagaatgttcagaggtgattgaagtactcagtaataataattgttttactttactaatgaaagatatattcatccaacattatagtagtgctgattcctcagcatctcatttgcatgttatgaatgtacttatatgtggatcttatcaaaattaaacttttttaaaacttgtaagcattcccctaagacttttgccatttattctattcacttctcttttgcattaatcccacacatgtgcacttacttcttagatagttgtcacatgaacacaccttatttttcacgttaatttcctctttgaaaaatctcttaaggcagaaatcctggctgccactgctgaggaagcagcaaatggtctaaatcagttgtggtggtttgttctattttttaaaaaaataattaatttgctcaaagcacatttactttaatgttaaacaaatgtgctttttccaaaatgtgcaaatgtgtgttttccagtgtgcaaagaatctgatactgtgctctatatagtataatcttttttgttttaaagaatactattcattctgcagaaactttagttgtgcctttggataatatgggtaagagggattatatgctttttttcatggtctagagacattctgtgacacaacttattttgtgtttgctcagttttttcagatggaaaaattaatatatttgttgtgaacatcaagatgctgttataaagcactgtgagatctcaaatgaaaattaattatggcatatataaataaccgtacaaccactattgtacttcagtcagtcagattcaaagtattttgattgttttatggatcctgtgagcatcaatcacaaagtttcatctagtagataattgtaggtgcaattgaggaaatacttttgcaaagcccattaataagtcatgcaaaaatgaactgcttattttattctgcttttgttcctcccaaggtataaaataattacaggaaagccttctggtgcaatatctggagtacagaaagcagaaaatggaccaattgactggagtggagacatgcctgtttcttgcagtctttctcggtaagtatggtgtacctaattctcatcttttgcactttggtgtttgaaatctttgttgcctagaaccacagatactcaaatactgaagtgtagtttgattttattttaattagatattgtcaaagcatgtgctttgataaatgatttttgtcttcgtggtggtgaaaagatttattctctgctatatgaataatttcccaagatcttcattaggacacagggcatacatttttgagattggtaatcactggtcttggaattcttcccagtgtagggatcatgctcaggaccttagtatcttttgtaatgacctccatattgatggataacaaatagtggattagatatgagtaaatttctcaactggagttgtaaaaagcaaacaatgaagagatttagtattatcttcattttaaaaaattcaaattattcaaagggtgagaaataatagttttttgtactttttagcatttcaaatgttcatttgggtcttgtttaatgtcacagacagaaatcaaaaaaattatattgtcatttaagaatcctgttaccacaaagaaagaattaaggtaaaagaaattaaaagtagaaagtaaattattttgtatttcactctggaaacaaagccaagacatgcatcggtatttagtatctgtgattactgaattagcttccatttttcttgagtgtggtagttatataatccttaattggacacaagttatgaattagtggcttatcaccttttttaagttgtgggtgctttttgtatgactttaaataaataaatatataaaacaagctaataaaatatcacttatcattttatatgttgggttctgtgaaaattcatttaaaccaagagttccaatgctgaaatcattttcaaaaaccactattgttaacagttttttgtgtgtgttattttaaaaagtttccaaaatgaaatcgtcatgtaactagattactaagagaaattcattgtgttggagagtagaaatttaatattataactgtgatttgtgttaaatttttatttaggaaatactcattttggggatctcaggcaaaactgataaagtgtaaagggctcagaaaatgaacacttgctggtaaataattatattgccaaaactcagaatcaaaaaaatctgatgatctgaactgcagcatatttctggagggtaacaggcattatctatcgaatcagtctttagcataccaagttacaaattctttgagaaaaattgcttagatgccagaaagtatattatataatttttttgttttaaatagtaagaactctaagtactacaaatcagccgtgaaaacaactaccagaaatgtaatgggtcttggcacggtggcatacacctataatcccacctgctcaggaagctgagacaggatacttgagccccagagtttgagactgcaatgcataaagcatctgtgaatagctgctgcacttcagcctgggcaacataacaagaccccatttctagaagaaaaaaagctataattccttattcattgatgagtggcattaaatgaaggttacctagctttctgaaaagttgacagattttaaattttttaaattaatctaatatagtaataatgacagttcctttgatttgctggtaaatactatgattttttaacctagacagaatatgatatattcactcttcaagtaacttttcaatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttcttaaactgtaagttttacaaaagtactttcattgctgtgccttctttcaagttacataatcacataaccacaaatggcatctaccaataaaccagccaggttttgctaagtgtactatcctgccatgttaaaatatcaaagcctaagtcttcattgttagcatggttatttgcctatgataaccctatgcagataatatggttactattaaccataataatggttaaagcacctggctccggaaaaataatcagtgtttgttttatgtaaacaaaaacacattacacccatgtgattaaaaaaaactacccatgtgataaaactgcatataaagttttggtcaatgatggaccatatatacaacactggttccgtaagattataatatcatatttttactgtaccttttctatgtttagacatgttcagatatacaaatactgtttctaattatgttacagctgcctgcagtattaagtacagtagcatgctgtacaggttcgtagcctaggagcagtaggctagctaccctatatagcctaggtgtgtagaaggctataccatgtagttttctgtaaatatactctgtgatgttcacacaatgatgcagtttttagaactattcccatcattaagcaatgcatgactgtacacatacatatacttgcatgtaaaactggggaaatttgagtaagttgggtgtatcaatgttaatagctggttgtgatgctttgctatatgcaggatgccaccattgggggaagctgggagaagaatatatggtgtctctcttcatcatttcttagaactgcatgtgaatctacagtgatgtcaatgttttgtaaaaagctcacccagtgtgattatcgttaataataacttaattgtacattttaaaatagctaaaaaaatataatttgattttctgtaacacaaaagataaatgcttgactggatggataccccattctccatggtgtgattattatgtattgcatgtctgtaacaaaacatctcatgtacctcataaatatattcatttcctatgtacacacaaaaattaaaaacaaaaaattttcaaaaggtgacacagtggaggcttgtagagccaaattacaatattgctgctgaaacatttcttttgatgtcattgatctattcatggggaagctgtcttttcccccgaagcatcattttgaaaatacctagttttattaatgtatttaacaaacatatagtcacataacaagtgctgttcttggttctttacatatttaagccatttaatcctcacaacaattctgtgaagtgggtactgttattatttccattttactgatgaggaaacagtgcagaggagttaagtcacttacggttttataggaagttagtggaagagctgagatttgaacccatgtatctgattcaagtcagtgctctaaaccgctctgctatgttggttctctatttgaaaatattaataatcttggccaggcacagtggctcacacctgtaatcccagcactttgggaggccgaggcaggtgtatcacttgaggccaggagttcgaaaccagcctggccagcatggcgtaaccctgtctctattaaaaatacaaaaatcagctgggtgtggtggtgcatgtttgtaatcccagctactcaggaggctgaggcacgagaatcgcttgaatccaggaggcggaggctgcagtgagtcaagatcgtgccactgcactccatcctgggcaacagagcgaaactctgtctcacatacacacacacacacacacacacacacacacacacacacagaggaaagaaaatattaagaatcctgtatattacacaggtatccaaacataaaaatactttagaattgcttactgtatggacaggttatatggaatggagtttgtagtatccacattaacaaagcaagtttatatggactggttatgatattagggatatgaattagaaatggatgttgttgcactcatttaaaatattttgcctctcactttatccccagttatagtgtccttttgaatttttctcacacagtgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaagtaagttgggatttttcttgtcgttcttactagccattagaaaaatacagccagcctgggcaacatagtgagaccttgtctctacaaaaaaataaaacaaaaattagtggggcatggtggcttgcacctgtagtcccagctgcatgggaggctgaggtaggaggatcacttgagcccaagaggcagaggttgcagtaagccgagattgcaccactgcactccagcctgggagacagtgtgggaccctgtctcaaaaacaaaaaaatccacaaagtctgtcattgtagaaatgattgtcatccttataaagctgatgataatattagtgtagagctttcataaatattaaaattttataaattactatagttgaaagagagtaattgtaaaattgaaaaagccttgtagacatgatttgacttcaaatattttgtttcctaaaacgataaaatcgtttgtcatacgtttcactgtaactctctttaaaaagtgttttgctaacactcaaaattaccttttatatcataaatttcagcaaatattttttgtgtgcagtatgtatagaacattgtgccaagctttagagtctaagaaaaattagatctgcatttttagaatcttttaaattactcattctactggtagaaaaaaaaatggatcacccagaattttacagttctatttgaaggttgggatttgatgtagatttaaagagaagcattggactcattgtgttggtgtatatttaaggaaaaaatgaaactccttagaaatatttgaggtaatttgttagagaatgagcattattgtttgaagtggtgtttttttaatcacgaaaactacattacagattttgccactaatgtttaatttagacattgtgtttgctctataaaggataaagtgattttttcaaaaagttttctttctcattttattttacttcatatttcagtttccctccctaaagtacatccacgttatgatttagacggggatgctagcatggctaaggttagtatttaatttaattactatgtaaacatctgaatttaatgtatcctatcaatagtggaagcaataacatgtattgtgtcttcatgtatgtctatatgacttaggaaattattcacttaaattgataccctttccaagtgattttgtggtctttcttttttactttttatcctttcttgaattcattatataagaaaattctctccattgagatagtgcatgtttagataatgttaaggataacatatttattatatttatatctatttttaactcttagaaattggtggtttattgtgtttttaattaacctgataaaaatgtgtaagcttgaataattttgtgtaaaagtttttcttaccctataccacaattagcaccaaatattgacattttatttctttattaggcaataacaggggttgtgtgttatgcctgcagaattgccagtaccttactgctttatcaggaattaatgcgaaaggggatacgatggctgatgtaagtaatagattgaaattttgaaattgattttcatgtagaccttgccccatcattgatattttctctcttcaaactagttaggttaggtgcttgatttttattataatacatttgtttcacatttagtttataaaacatttagcagctcatttttcatgagtcctacaatgaccttgtgagacagaacaaatagtatctgaattttaaaacttacaccacgctataggatgtgacggcaaatgcatttcttttcctaggaccttgagtagttggttgtcatttaactatgttagaagtctttggcttgttagaattcagtacaatctgtactttctagcatttaagtcctcaaagtcttccttaatttcctaccattttcccaaatgaagtacacagtccttttttatcacaccgtattttttttttttctttttgagacagggtctcgctgtcacccaggctggagtgcagtggcacaatcacagatcactgcagcctgaaactcctggcctcaagtgatcctaccacctcaccttcccaagtacctgggactataggcatgccccaccacacccagctaatttttttttttttagtgatggggggtctagttatgttgcccaggctggtctcaaactcttgggctcaggcaatcagcccgcctcagctgggattataggcatgagccacacccagccttcacaacattgagatataattcatatactatataactcatgcatttaagcatacagtttaatggtttttattatgttcagagttgtgcagccatcatcactaattttagaacattttcatcaccccagaaagtatctctgcatccattagtattcactctccatctccgcctaaacagccctgccctaggcaaccactaatatactgtttgcctgttccagacatttcatataaatgaaattatacaatatgaatatataatctaacaagcaatttaaaagctaattttttaaaactagatcgcttaatatagttattctagttcagaataactggttatctagtttaagtagtttcttcctgaaagtgactctaagaaatgtaagatggatgtaatttttacctgttttttactttaatgatttatagatgtcatctttccatctgaaaaaaatggaaaatacattatctcttttggaaattatgcttgtttctacacatcattcaaagcttttgaattttgcgtacacatcatgatggccttgtggccgacagatgttaagaagtttgttttctgcactcatgtcgctatgtatgtgcccttggactgtaatgcttttgacagtttatgtatgcctacctcatacccaccccgtcttgcaaaagtgtgtatgaagcatttcatcactctttttaggctcctttttttttctgttagcattatatgaaacccataaatttgtgtttatctttttcactgtgttcacatatcttagttcctaagcctatgcttttctgtttccactaagaagcttccttgtttttactggtttctggaaaaatctctgtgtactaacagtttttattttctcttatctatcgtcaattgctgatccatgaagcttttattccttttacttattagtttatagtccaataagtcatgagaaaatagttttaatgtaaaccactgttggcaaacattttctttaaaggatcagtctaatattttagactttgtgagctgcatatggtctcttctttgtttttacaatctttaaaagtgtaatgttagctcatgggccatacaaaaagcaggcctcaagtcttagtttgttgatccctgatgtagatcaaaagcccttcaattatatatttcttactgtgtcatccttcttcagatgacatcacaagttgagcatccctaataaaaaatattccaaaagtcaaatctttttgctcaaagtttatgctcaaaggaaatactcattggaacattttggattctcagattagggatgcttaaccagtatgtatatatgcaaatatcccaaaatccaaaatctgaaaaacacttctggtcccaagcatttcagataagagatattcaacctgtaattggtttaaagtataaatcagacagtagtctactctgagtagtaaaaattaattctggtggtataaactgtaatgctctacaaactatttgtgtaattgtagattagtttttactccttaatgtaattttaataccttaggtttttaaactgttaacctaagtagtaatggtttgtgaaaatatgagttccctaatacatcaggatcacagaaatgcttattataataatgtttcaaaaagtgtgaattgatgaatatcatgaatattgttataaaatgtttttgaactgtagtactgcagtataattagtgatagatagaaaaaataactccttagataaactaattagaataattttctttttttagtgaattaattaaagatgattacaatgaaactgttcacaaaaagacagaagttgtgatcacattggatttctgtatcagaaacattgaaaaaactgtgaaagtgtgagtagactacttccttactagtaggggttaaattattaaatgttccatttctatttaaatgacttagttatccttggcacaatatggcatgctatgctagggtttctattaaagatcagcggcctggcacggtggctcatgcctgtaatcccagcactttgggaagccaaggcaggtggatcacgaggtcaagaaatggagaccatcctagccaacatggtgaaactccgtctctactaaaaatacaaacattagttgggtgtggtggcgcacgcctgtagtcccagcaactcgggaggctgaggcaggagaatcgcttgaacccagaaggcagaggttgcagtgagctgagatcatgccactgcactccagcctggtgacagagtgagactccatctcaaaaaacaaaataaaataaagatcagccttagattagtgattactttatcatcacaaaggcaaaaatgccagttttcttggtaagaagtgaacaccatctcttagtggcatttcctcccagccattgggcaggaaaaggtagtgggaaaaacatctcatttctatcttgtaaaacagaaactgtgaataagaaaatatgaaacttgtaatcaacaaaggaaataggaagagatattctagaacagccttttagtagtatttttagaattataggaattacttttagtttatttttacttgttaatcttattcctgagaacacgttttgaaacagaatgatatttttaactgccctctttctagaatatactatttgtactgcagaggaaatacaataaatgaaatcagtattcactattgaccttcattaattctgaaatgtatttttactattatcctcatataagattatttgaaattaatttgtcttttctgttttatccatcccttaatctgcaaatttaaaatagaagcagataaaattccttcttcaggaaggcatcaggtttttttgtttttttggtttttttttttttgagagagagtctcactctgtcatctaggctggagtgcagtgatgcaatcactgctcactgcaacctccgcctcccaggttcaagcgattctcctgcctcagcctcccaagtaactgggactacaggtgcatgccaccacgcccggcttattttttttttttttgtatttttagtagagatggggttttaccatgttagccaggatggtctccatctcctaacttcgtgatcttcccaccttgacctcccaaggtgctggaattacaggcgtgagccactgcacctggccggcatcaggttttttttttaacaatctgctggcttatagactttgaatcaattttttatttttaaatggttatgatgaaagctgaaattattatttataaaacatctttttaaaactatgtattgattatactcatttaattttctcttttgacttttcatacagatatgaaaagttgatgaagatcaacctggaagcggcagagttaggtgaaatttcagacatacacaccaaattgttgagagtaagtgtttacaaaattacgaaatttgtaagctcataacctattcctttgctggcactattagatttaaactttcttaggagctaggcatggtagtacacacctagagtcgcaactactcaggaggccgaggcaggaggatcacttgagctgaggcattaaaagctgcaacgagttatgatggtgccactgcaccctagcctgggcaactgcacgaaatcttgtctgtaaaataaataatttaaataaataaactttcttatagagatgatatttctcactgcagagaaagaatttttcccatctttagaaacttctttacaatattaaataatcttactgccttgaaattttttgtaacatattcaaatgactactgtaatttaaacctctctcgctgcctctctctctctcggtgtttaaatccataatgctcttgtgttcttgctgtggcagttaaagcaagttcataaatgtaatttcacatgcagttgaatgtaaagtgcttgagcttgtttagaaatagatttaaattaggctgggcgcggtggctcatgcctgtaattccagcactttgggaagccaaggcaggtggatcacctgaggtcgggagtttgagaccagcctggccaacatggtgaaaccccgtgtcattagctgcgtgtggtggtgggcacctgtaatcccagctacttgggaggctgaggcaggagaattgcttgaacccaggaagcggaggttgtagtgagtcgagatcacaccattgcattccatcctgggtgacaagagtgaaactccatctcaaaaaaaaaaaagatttaaattagaaaaatattatcagatttttttctaaaataaaaaaggaaagaaagatttgaggtcttcaaggcagtaattacttctatagctagaaaaagaaattaggacacaagtctctactctgctgaaaaatacaatagaacttctgggagtctctgaatctcttattaacatgtattatagaagtgcgcaggtttatatattagtaatcagtgagagctgattactactcccagacctgccccatttacctgcctactcatgactggctacttaagcaaggccttttaattctttgcatccttggtttctttttctctaaaatcagcaatttcttaccctgcccgtcttatgggttgttgtactaattaaatgagataaataaaaatactgtactcttggctgggtgtggtggctcacacctctaatcccagcactttgggaggctgagtcggatggatcacttgagtccaggaattcaagaccagcctgggcaacatgatgaaaccccatctctacaaaaaatacaaaaaaattagccaggcatggtggtgcatgcctgtggtcccagctacttgggaggctgagacaggaggatcacttgaaccgaggaggcgaacgttacagtgagccgagatcgtgccacttgcactccagcctgggtgacagagccgagactgtctcaaataaataaataaataaatatattgtaatcttgcaagcttttagtattcgaagtattctttcataaaatggatgttaaattaaaagtgaaaggaacttgatacgatatccttttcactttccagcttaggctgatgtttgtttcttttcctcagttttagatctcaaacagtggttttcaaaatatgagtaatgaacaactagtaggttatgaagttgggtgccttgtaatcagcaatgtatttttcagtggaacagaatagaaaatgtcagaatgtgtcacatataataaggaaatcattgtttatgaaactttgattcaggtatatacacactttaaatgttactgagttaaaacagtgagtttcttactatgagttgtggtcaggaaagtttgaaaaccatagctatagaataaggtgattaaaagtcagaaagcacaaaatagtcttccccagtatttgtctgcatttaaatataggcagccatattgctgtcagtgttttatattcttctctgttttcaccttagaacatgatttacctgctcataggcctagtggacatttatttccagggccagcatcgtttgagcactttaaatcaaaattaatatattttcttttggggatctcaaaatgtttctcatttttatgacattcctgtgagattaagatttctttttatttattcatttatttttaaacagagtttccctcttgttgcccaggctggagtgcagtggcgcgatcttggctcactgcagcctccgcctcctgggttcaagcaattctcctgcctcagcctcccgagtagctgggattacaggcatgtgccaccacacccagctaattttgtatttttagtagagaagtggtttctccatgttggtcaggctggtctggaactcccaacctcaggtgatccgcccgccttggcctcccaaagtgctgggattacaggcatgagccaccttgcctagccaagattaagatttcttatgagaaagcatagatgactaaatagcttgaggtaatggagtcttatgacatcaggacttctcacttcaagccaattacttttccgtagatatcattttttctctttttcttttttttttgagatggagtctcactctttcgccaggttggagtgcaatggcgtaatctcggctcactgctacctccacctcctgggttcaagtgattctcctgcctcagcctcctgagagctgggacttcaggcgcccgccaccacgtccagctaattttgtttgtttttttttttttttttggagacgaagttgctcttttgcccaggctggagtgcagtggtacagtctcggctcaccacaagctccgcctcctgggttcacgccattctcctgcctcagcctcccgagtagctgggactacaggcttccaccaccaggcccggctaatttttgcatttttagtagagacggggtttcaccgtattagccaggatggtctcaatctcctgacctcatgatctgcccacgtcggcctcccaaagtgctgggattacaggcgtgagccactgcgcccggcttcgtagtggagaccttacagacatttttcccaccacaaaagtaaaatttataagtagaaaaaaataccacatatattatgcacccaaaaaatgatgcttaaaagttttgtccattgccctgcagcagtgcttctcagagtggctcctgggccacaggtcgcagtggttcacacctgtaatcccagaactttgggaggctgaggtaggcggatcacttgaggccaggagttcgagaccagcctggccaatatggtgaaaccgtgtctctaataaaaatacaaaaattagccgggcgtagtggcagacgcttgtaatcccagctactggggaggctgaggcaagagaatcacttgaacctgggagatggaggttgctgtgagccgagatcatgccactgtcctccagcctgggcgacagagaccctgtctcaaaaaataaaaaaaaagtaaagaagagtggctcctgggccagcagcttcagcctcacatgggaacttattagaaatgcacattttgggaccccacctcggatgtgttgagtcagcaactcactggcagaacccagcaaaggccctttttaataagccttccaggtgattctcatgctgctaaaatctgggtaatcactgttttcattttcttttatatgtattattaaatgactgttactctacaaacatatggttgttatttttactttttggataccattatagtgtaggcatttcccaggtttttttggtaacaccattttcttaatgatatgatgttgcagccagtggatttattacagtcttacttattattgctctactgttggtcctttagtttgcttttcactcttctatgtaatgctgtaagaaatgactttttccataaactattttccatatattggatgtataatttaacacattctaaacattaatgttaaaacagacataaagcataaaaaccgagatatatatttgatcatataaaaatttaagctgggcacagtggctcatacctgtaatcccagcactttgggaggccaaggtgggggtagactggttgagctcaggggttcaagaccagcctgggaacatggtgaaaccccaactctaccaaaaaaaaaaaaagaaaaaaaagaaaaaattagcaagacgcaatagcacgcacttgtaatcccatctactcaggaggcttaaggtgagaggatggcttgaactcaggaggcagaggttgcgggagctgagattgcaccactgcactccagcctaggcgacagaatgagactctgtttcaaaaataaaataaaaatttaagatctgtacatgtttaaaaaatgttagaatgcaaataagttgggaaaatgtgataaagggttttttataaaaaataactcatacaaattgataaggaaaatagtcaatctgcaaaaaatagatgagcacagaacatttagagacaatttataaatgaagaaaatatatctggtgaaaacactcttgaaaaaatgctcaaatccaatagtaagaaaaaattgcataacagtaagatactatttttgtctttcagattatcaaggcttaaaaaattataatgccagtgctgacaagagtgtggtttaaagggcatccttatttgttgctagtggcaatgtcagctactactgacaacattatttgaaaggcaatagtgtgtatcaggacctttaaaatatatggacatatttatcctttaagtctaaccttcatcctttcttcataagttttacaaatactgtatgcatttctgtggtaggtaagtgataaacttactaagcttaaaatgaacagaatcttagatgaggtttcttttcattttctgtttttaagaggagttgctttggtttggcctctaaacaagaagagcacaaatcttgctgcctacacagttgatatttggaactattctagtggttctatttaattttcaaaaccgggttatgaaatggagaattaaccactttttacagataaggaaacaagattagaagtattttacatgtggttttagaagggtgtttactgaatgaactgttttataagatgtattactgctggtctcatgttttattatcatactgtacccctggtggaaatcaacctaagaaactcttttgtatttaaaaatggaaataattactgtgcctttgaattgaagtaatctacaaaagaaatgtggtccagactttagactttgttgggactgtgatgatcatttctggcttttggcaatctggatctgaacctttggttttatttagctttccagttctcagggaacaatagaaaccagtcttcaggatatcgacagcagattatctccaggtggatcactggcagacgcatgggcacatcaagaaggcactcatccgaaagacagaaagtaggttatagctttatgcgtagtttctgctcttattaatgtcctttttcacattgactcagttaatttatttgagtttttcttccttaaatagtgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaagctgtttttttcagagatgtgattctgtcaggaaaaaggttgattgtgttaaaaaaaaaaaaaaaaactatccttaaaatcaaccttttgaatactttaaatcagggtcatgaacaccagaacctctaaaggccaggcaggtaacagaaaggaatgagattggccagtggggactcatctacaggggagagccactactcatattcaccaaaggtattgcccaatcttcccatttctcaaaaaaagctagaaatacagaatttgttagaaataccttgatttttaaatgttaactgttaattgttttttacattgttatttacagaccaaataaaagcatctgtgggccataagtaaccaatgagccacaaatctatgacatctgcttcagactcttagcctttttgaagcaataatctcaaaagaaaatacattgtgtataatattatgattctatattaacaacagtaatatattttcctatttctaggattagcttataatgaagaacaaatccacaaatttgataagtaagtatccagattatgtttaatagttatttttggtgctattttggttatctttattaatatgattcttcttaaagttgaaattaattacaatttaaaaatacattttaatcttgattttacaggattgttacaatatgtagacatttttgaggttcacacatctgctccctaattgggaagttaccatgatgggagaaggaggggggagaaagattaccatttcagtcagtcagcttctgcctcatatgctctgattacagaagtacagataatacagcacataggcaagggcagacttaactaccgtcttaattttaaccgcattcaataggcattttttttacatccattttgaaccttctctttatcttcttgctgctataatgtctatcttagaaacgtttactttctcctgtaaatattctaaagccacaacaatcattataggaaagatacatttcatatatttgaaaatttctaaatattgaaagtagaaacagtgacattggtttaagcctctgattatttctaaattacaggcaaaaactgtattaccatgccacaaaagctatgacgcactttacagatgaatgtgttaaaaagtatgaggcatttttgaataagtcagaagaatggataaggtgagtaaacttcttttggagtgattagtggttgactgcacaatataaatgtatatttgaagtaagaatgcttcactagactgcatatcaattgattctttttggttttcagaaagatgcttcatcttaggaaacagttattatcgctgactaatcagtgttttgatattgaagaagaagtatcaaaatatcaagaatatactaatgaggtaggtacagctgtcaaggaaaaattaaaattcttctcagtttataactgatagtgattgacaagggagaaatgggatagaatgtgcctacattcagttccacccaccaatttttaatatgtattttgagccaagttttaagaatgtagatgttttacaactaaaaacagctgataaaccatccttttatcaactgtatgaaaagtttctttcttaaaagggtgttgatttaagtattgtatcatcgatagttttgaaatcaaaatttaaagtttttttaaaggacttattaaaagctgtaacacttgatgtcagatctgtagtaagtacttttgttctgtgattaatgtggggtttttttcttttttttttttttttgatgtttcagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgctttcattgcagtttgtgcttttgctcttacattttgaaattttttatgtttgttgtaatacaatgtttaataaggttatctattgaccagttaaaagaaaataaaacataaacatcattctaaaacatttgcatactgtttttgagcaaaggtgcttgtttattttattagtatgaagaaattaaaggaagagatggaaggggtggttaaagaacttgctgaaaataaccacattttagaaaggtgagtaatgcaaaaataattactgtgattttctgtgcaattgagttcattcacatctgtacttatatcttcctgtatcaatagattcagcagtggtaaagggtcataaagtcagaactcatgtttttctctctatgattgtgtatctgtgatgccttttaatggttgattagttccattttatagaagcactggttaatcgaattacttatttgaatcagtttgtaaagatcaaactctatttacattatttttataacttaattcattggaatcataattttcaatttggtgaatcagagttgctttttaagataccagcactttggtgctgagtagcttacggggtcctctgcacacctccttgcaggtgaaagccacaggtaaatgcagtactttgaggagttaggtgtctgcttattatctgcaaaatcctaatagataaggccaaagagatttgaaagcctgcagaggcaataaagcaatttttggatggcagttttccttatcctgattcctcagagaaattaagtcatatttggctctgtaatagaaccttttctttttcaagcccttaggttctcctctataggttctcaaacgcttgtaatgctaataaaaatatttcacatttggccaggcacggtggctcacacctgtaatcctagcactttgggaagccaaggcaggcagattgcctgagctctggagttcaagaccagcctaggcaacatggcaaaaccctgtctctaccaaaaatacaaaaattagctgggcatggtggtgcacacctgtaatcccagctactggggaggctgaggcacgagaatcacctgaatctgggagatggaggttgcagtcagccgagatcacaccactgcactccagcctgggtgacagagtgagaccctgtttcaaaaaaaaaaaaatggatatggaatttttgggtcagagagtatgtcaatttcaatttttgttgggttttactaattttattctttttttttttttttttttttcccccgagacggagtttcgctgttgcccaggctggagtccaatggcgtgatctcagctcactgtaacctctgcctcccgggttcaagtgattctcctgcctcagcctcctgagtagctgggattacaggcgcccaccaccacacccagctagttttttgtatttttagtagagctggggtttcaccatgttggccatgctggtcttgaactcctgacctcaggtgatccacttgcctcagcctcccaaagtgctgggattacaggcatgagccaccgcacccggccaattttgttctttaaaagggtgcatgttatagtcctaagcagataaaacctatgcatttggcaacattgaatgtataacatcttttaaacattcgccaatttgtttagtaaaaaccgagatcttattttaatttatatttctgtggtttatagtgatgtcaaacatcgtttaatatgtttgttcaattttcatttttggggagagttactcgttaactttaaaaaatattttccttgtttatagtaattatctaacttttatagtatccagtttacagtttcttcagaactttagctaaatccttttaggcttaaagatcaccaagtagaagagactataaagatgtgctttttttttttttttttttttttgagatggagtctcgctttgtcgccaggcgggagtgcagtggcgcgatcttggctcactgcaacctccacctcccgagttcaagcgtttctcctgcctcagcctcccgagtaactgggactacaggcacacgccaccatgcccagctaatttttgtatttttagtggagacaaggtttcaccatgttggccaggatggtctcaatctcttgacctcgtgatccacctgcctcggcctccctgagtgctgagactacaggcgtgagccaccgtgcccagccaaagatgtgcttttaacttttatatttaactacttatgccttgtggaataaaatcccaacttcctaaaccacatttagtaagtcagttcctcctgtgttttatttgcaggtttcttgacaatatataggtgatataacatggcataatcttaacgtaaatgttaagtgacaaaactagtaatggaagccagattttgttcagagtattatactactctgtctccatgtggataacccactatcacttcaaatttttttttgaatctaaaatcatctgtcccaactcagttttctctctgctccttatcctgttcaaaggtaccacctttctcctactcccttaaacataaattattttagacacttaatcttctttataccctctcaacaagtttggctcccatatttcccctcgtcaccctcattcagatctcctttccctttcatatgtgatatatggtaataacctattttttttcttaaccccaagctcttcccatctgtcatgggtattacagccaaaatcatctttcagaatactgatgtaatcgtatgacttctttggctcaaaagtttctaaactcctgttacctaaaaagtcaagtctaaatttatacttcaattcaaagagtgtaatagcctggttccagcctgttcacccaactttacttcccactgctccccaaaataacattgtgttctagcaaggtctcatttctcaacttcctttgggtatgtcacactcccaactcggtatctttttttttttttttttttttttgagacaaagtctcactctgtcacccaggctagagtgcggtggcatgatctcggctcactgcaacctctgcctcccgggttcaagcaattctcctgcctcagcctcccgagtagctgggactataggcacacgctaccacacccagctaatttttgtatttttagtagagaaggagttttgccatattggccaggccggtctcaaacttgtgacctcaagtgatctgcctgcctcggcctcccaaagtgctgggattacaggcgtgagccactgcgccggccccaattctatcttagcttataaatcccaccccaccagaaagaaattatccagttcttactgacagtttcttaattacatcattacatcggtttttcatgtatttatgataataccatgctgttccagtaagaaatagaacaaatcatagttacttaaactctttaaaaataaatagctatttattcctctgaaaagtattttaaggttgggggcctttatacataaatgcaacttttgagattacctttttttctttgtgtgtgtgttttaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagtt

SEQ ID NO: 2612 - DNA, 44312 bp, Homo sapiens
gcccgcgggctgccgcccgcactctccaagagactgctggcgccggcgcccgcccgcgcggcaccgacgcggggagcgcgcttcgcgctgactcagcggcggcggcggctgcggcggcggcggcggcgttagccggccctcgcgctctttcccttcctggggcgccgaccccgcccgcttgcttgcttgcttgcttgcctgcctgcctgcctgcccggcgccacgcaagagaaggtgccaggggacgcagagcgactagaggcgcgcggtcccggccagcaccgtctctggcgttgtagctgcggccgtggcggaggactacggcgacaaggacgagggccgctctcccagctctctgcgtgccgcgccgctccgctccgctggctgaccatctggagtgcaggctgggaggcgggatggagtgatagggaaggtgactcggggctcgggggcagcgggaccgggaccaggtttggtccgcgtgaggcttcgaggaagttggccggggcggaccggcccgggggagtcccgacgccagggagggtgcaggcttgggaccctctatggcggtgcaccccctggctgggcggaccgggtgggggtgggtacgagccggggccgccgccgaggagcgcgtcccgagtgcgtggccggcggttgcttggtgtttcatcacccgaattgccacgaggcttcctttaggggagggatcgggggagggatgggagcaaggctagcagaggagggtcggcatcgcctgtggttccgaagcccgttagtcatcgttgtagcgttatcaactgtggagacctcaaacttgattcttcccccacccctggacaaaaaggaaaagtgttatttctgtgcagtaattggccagcacggacgctccatttcttctcaaaccttcctcaccatcctgcaggactagagaagcatgaggtttccctgtaaccagaaaaacgagtactttttgaaagtgctaattagttgtggcgggcgggggttgggggagagttacgttttattaaaccgacttgtcagcgtggtgttaaaaggctggaaagattcagtcgtagtatttgaaacagtcttcagtaggtgtagaggaatttttccaaattgtttgattcttaatggctatccaggaaaagttaaggcttaatattttaagtatgttgcttgccttcccccaagaacctttgcaagatgcataattgtttaccgtattgaaacattttttggggttttgttgttgttgttttgagacggagtctcgctcggtcgcccaggctgcagtgcagtggtgccatctcggctcactgcaacctctgcctcccaggttcaagtgattctgcagcctcagcctcccgagtagctctattacaggtgcgccccgccacacctggctactttttgtatttttcgtagagatggagtttcaccgtgttagccaggatggtctcgatctcttgacctcgcgatccgcccgcctcagcctcccaaagtgctgggattacaggcgtgagccaccgcgcccggccttccactgcatattgatcgtccaaatgccttctatgtgggggattctttctgtagtgacaactgttaactagtttgtttccttgggtttattggctatgttttccttagggccacttcatttttctcccgatagcttcagagtgacttgaccaagcttaagcactttttcttttttttgacacagtgtctcactctgtcgcccaggcgggagtgcaatgacacgatctccgctcactgcaacctccccctcccgggttcatgcgagtcttctgcctcagcctcctgggtagctgggattacaggcgcaggccaccatgcccagctaatttttgtatttttagtagagacggcgtttcaccgtgttggtcaggctggtctcgaactcctgacctcgtgatccgcccacctcggcctcccaaaatgctgggattacaggcgtgagccaccgtgcccagccagcaattttttttagatggagtttcgctctcgttgaccaggctggagtgcggtggcgccatctcagctcactgcaacctccgcctcccgggttcaagcgattctcctgcctcagcctcccgaatagctgggattgcaggcatgtgccaccacacccggctaatttttgtatttttagtagagacggggtttctccatgttggtcaggctggtctcgaactcccgacctcagttgatctgcgcccccctcccctcggccttccttagtgctgggattataggcgtgagccaccctgcctggccagcatttttttaaaaagccatagcaaattcaaggaagcttttattggacttctcaatcagggattcttagaaactccgaaatcgttttttctctctgtgggcatttttcaggggaatggacatcagattttcttaacatttagggggcgaagggaaccagtgcctttctttgtgtttttctgtcttttaaaaatgctgatctggtataagaatgccccaagtcgtttccattccacatgttcctacctctgactataaacaacgtattgagggctcactatgtgccagccatgctctgcataccttatctctttgaagcctttacaactttatgaggcatatggtctttttcccatgtcatagaaagggttctctcaggttttgtaagttgtccaagtggccccaattaaaaaatgacaagatggggatacaaacccaggtctttgaaatccaaaacctatgctctactatgtcctagggacatagtgatggatagtcaagacagtccttgccctttaagattgtgagaaatggccgggtggctcacacctgtaatcccagcactttgggaggccgagtctggcagatcacctgagattaggggttcgagaccagcctgggcaacatggtgaaaccccatctctactaaaaaatacaaaaattagccgggtgtggtggctcacccctgtaatctcagctatttgggaggctgaggcagaagaatcacttgaacccaggagccagaggctgcagtgagccgagatcatgtcactgcactccaccctgggcaacagagtgagactgtctcaaaaaaaaaaaaaaaagattaatgagagaaaactagtaagctggcagtgacagcatagcagtgcttaggatggggcatgtaatccaatttgggagagttggacaatagaggtcaaagaagtgttcttgaaagagatggcttctaagttgaatttcaaaggacagcaggggttaacctactaacaagaagaaagagcagtgtgcaaagatgaaaggtagaataccactggagaactgccatatggttcactagcactggccttgctgacctggtgtgcagaatagtgaggagttattcaaaagtgtttggatcgtaatctgagggcagtagggagttacactgccttgaagtctgcaagtacgttatgaaccataagagaaagggctgagctgtcttcaaagctctcagtccatatcctgagttatttgattcaggcaggctcagaggaaaacagaaaagcctattgtaggtatcctgtaacctggacctgagcctggttttgctattcccaaaaggcctttctcccctacccctgctattcccaaaaggcttttctcccctacccccaatccaattagttttttggcgtctttggttaacggtaattgaaacaaaaagccccacagcctttttttgttttttttgagacagagtctcgttctgtcacccaggctggagtgcagtggcgtgatcccagctcactgcaacctccacctcctgggttcaagcgattctcctgcctcagcctcccaagtagctgggattacaggtgtgtgccaccatgctccactaatttttttgtatttttagtaggggattttaccatgttggccaggctggtcttgaactcctgacctcaagtgatccacctgcctcggcctcccaaagtgctgggattacaggcatgagccagcacgcctggccccccacagcgtttaatggaagtagtaagacttggtctccctaccttataggtcttgagagaataatatcatttttcacatcatttagagtttgttccatgtttgctcaaatgaatatgcattctatcaaaaactaggatgccttttgcagcttattatttgagaatgttggaacctatattgtgaagaagtggattacctctcagagattaaaaaaaatccttaaataagagtagtcagtgttaagtcatttgtggatttttttttgtgtgttttgttttttttgagatggaatctcactctgttctccaggctggagtgcagtggcgcaatcttggctcactacaacctctgcctcctgggttcaagcgattcttgtgcctcagtcacccgagtagctgggattactggcatgtgccaccaagcctggctgatttttgtctttttagtagaaacagggtttcaccgtattggtcaggctggcttgaactcctgaccttaagtgatctgcgcacctcagcctcccaaagttctcagattaccggtgtgagccactgtagctggctggtttgtgggtttttgtatctactattgaaaaacttttttttttttgaaatttttagaattggctggcaagagcagagatctgtaaaatgcaaaactaagtccattgctcaaaagctaaatgactggtttttcattatcctgttcctttcattagacttctgtcatagtacttagtaaacactccaaaggatattgaactctgaggtcagccattctaatgttttaaagaaggtttgtgatatttgtatctggaagtagacaaattattataattactgtaatagtctgcatttgtcatttttatacttaactgcagttgcacaattgcatttttaagtactagagataagtaaaacactgcataaattaggtacttctactatttaaagtagaaaatgattactttctataccttattaagaagatcttgaagactaagaaagcttgaggacctttatggcatactttaagatttttaggggccaggtggggtggctcatgcctgtaatcccagcactttgggaggccaaggcgggcggatcacgaggtcaggagatcaagaccatcctggctaacacggtgaaaccctgactctactaaaaatacaaaaaattagcccagcgcggtggcgggcgcctgtagtcccagctactcgggagggtgaggcaggagaatggcgtgaacctgggacacggagcttgcagtgagctgatacggtgccactgcactccagcctgggcaacagagtgagactccgtctcaaaaaaaaaaatcagatttttaggaattacacattagtggagtagttagcagagcccatttttctgagaattaggctctaacttttagttgtaatttagataagttccaaaataagtttttaaacatttaagcttctttgcatgattttatccatttacgttattcaggataagcatctatttgtttatcaagtaatgttttctttcaactttgttttttgtggcagatgtttataaattcttctgtgggatcagagggcacgcctattacaaccagaaaactacaagtataacagcgaggatggatgaacaggctctattagggctaaatccaaatgctgattcagactttagacaaagggtaagttactctgctgaatcattttttaatcatgtcaccacagattggcattagaggacttgaataaaaatgcacctggcaaaagtttactttgggtagaaatgaacagaaacaaaaaaatttgaggtatttgaatatattttgaatatagaaacagtgagtgttgtgatttattttctgtttacttggccaaacaaaagtattaaaatctcatatgattcaaggcagatctttatgcaacatcagtcattatttctaattatttaaaaattgtaatgcaaaggattcgtttaagagactttccatagcagcagacatgtgtattttattttctctttccttggcttgatctatacaagctgttttaacacttaccttaatgattttttttttattttaatttttttctagagatagggtttcaccatcttgcccaggctggtctcgaactcctgagctcaagcgatctgcccacctcagtctcctaaaatgctaggattataggcatgagtcaccctgcccggccacattagtgatatttaactttcttgttatttggtctaggcagacataaataagcagttatgataggttatgtcttaagtaaaatggttacatgacaagaatccattataaagtgctgggatagttggataaatgtaaacaattaaatataatgtagcctacaactataatcatgactatagctgaatgatagaaaaatataaagaatgagcctataattaattttttttaaagacgtgggcatttggaactatagggtaagtggaaaggaaagaggcattttctttttacttttcatagcaaagaatactttttataaatgagctaaatgaggttaacaatctcactaaaaattatagcagtttttattcttattttaagaaaaaaatcttttaaagcagtaaaaaacaatcccaactagtttctaatacagtaccatgtgcatgtctctgctactaaataagtaacgagcccttcagatacaggaaaataataggaattgagatttaagtatctggctaattacaagatacctatcaaacaagttaggacatcaaaagacatttaaaatccatgtcttctgtgtgtaaacaaatctttcttgtcatagggttttatgctacctaccttcaaacatagttgaagtatcatagatctttacctttagtctagcttggtattgcatgcttgtaattaaaagcctttgactgtatgtttagttattaaatggcctttactgttatttttatgtgcctcttgaaatctttcatttcttaagttccagcatccaatttttggatgaaagaggcattttctttgcctcttaagttccagcatccaatttttttaaatgtgccatgatttctttttcagaaaattaaaaccaatacattattagtggttttaatacagaagctctgctttttgtcagtaaaaatgggttctgtcacatacgtgttttaagcatccaggtccaggcataattcagtatccatttagccaatctgaataacaatttattaggatgaaagggaagaaatcttaaagtgaattctgaaagcccttttgttgcagttcgggagtagtggaaacttaattcagtttggtggtgagaagaatgactgtctgccaaccccaattgctcagttgtctatctgtaattctctgttttttacatgggcaataaaagttgaactgactcttgtcacatagagtcagtcaaccattagaaaaaaggtatggggtagaactaggtggtgaaagctaggacttgtttgtcagtgttgtagaattttgtttttttaattgttagtaatgcatagattcagaatacaaaggctttgtttaaaaactaaaaacttccacgttatctctcctctccttcctctcacccctgccccgccccccgcccttttttttttgagacagagtctcactctgttgcccagcctggagtggaatggcaccatcttggctcacagcaacctccaactcccgggttcaagagattctcctgcctcagctgggattagagtagctaggattagaagcacacaccaccacgcctagctaatttctgtatgtttggtggagacggggtttcaccatgttggtcaggctggtctcaaactcttgaccttgtgatctccctgcctcagcctcccaaagtgctgggattacaggcatgactcaccgcgcccagcctcctcctttttaaaaaataaaacactcgtctttggcttaaaacctgttattatttaaagaaaatggtatgtcatgacatttctagcagctgaaaccacctctcccctcttttgtaagtgaaatattaggtggtaatgcaacatacatgattaacttctaccttgtcctctggcctctgagatattcctaaagaataccctatgtttcatggactgctgttagaaacaactaagctagtactatcttttatagctgcctgtgttcttatagtcttaacttctaaagagagacattatttactctgggctgttttccaataccaacaaccaactctcttgatttctgtggacaccaactgggtgtcctacaaatcaattcaattctgacactaccaggattagcatcacatcccacaagttatgggctcggtcttacaaaccgcccccacttaagacactaattgagtccagaacctctcatatttctgatgatggagtagcctacagaacttagaaaaacagttgactttcttgtgctgatgaaggatccacctcatgagcagccacatggaagcgatgcatagggcaaagtataggggaaggggcacagagctcttgtgccctctctaggaacaccaccctctctaggaacaccaccctctcagcatctcgatgtgtttgccaacctggaagttcaagagtttttatagagctgaatcttgagtcccttctccccttcccagaggttggtggttagggtaaaagtttcaacactctaatcagttgatctttctggtaaccagctgtatcctgaggctgtctagtgttcccacaccaagttacctcattaacataaactctgttgaccccgaagtctctagtgatccttccaccttagcctcccaagtagttgggactgtaggtgcacgtcaccacttctggctaatttttaaattttttgtagagacagggtcccactatgttgcccaggctagccttgaactgctggcctcaagtgatcttccagcctcaagtgatcttcccaccttgaccccccagagtgttgggattataggtgtgaactgctgtgcctggcccaaaggactcattataaataacaaaagacggtcctgtcgctcaggaaattttccaagagttttaagggctctgagccagcaactggctgcaaagcccaaatgtattttttcgttataccatatatttaatattatatttggtgatcttcacctaatcatcttcatttacctggtcttctgtcagtgggagcagccattgagaccatgtatgaaaacccattccctcattcatacagttacatagtataggaaactatcacctaaatataaatacagtggctttgatctgtaacccaaagaaaaaaataactttacatctcgatgacccagtgtgtgtgtatatatttataggtacatatgcacataaataactaaaacaagttacagaaagtaatattcttgctagggtatagtacagaatatctaatattctctatttcatttttaaaaattattgttcaggacccataaactgatttcatcactagtgggagacaccaccgttttaaaaatatttaccaattgaaattaggtttctctaaggctaatgtttcttttacctcatgtcagcttttgtttcatacataattgctgtcaaatcatctagcagtgcttccagttgatgtgcaattttcttgtctattggagatacttgtcacaagatgttcactactatttgtccattgccatgtgtgaaacctgcatctggtgcaacatgctgatgggaagagtgcctgaagtaactcccattttcccaacagtttggtagagagcgtatggacttggtgctgcatccattctagagtactcttgctccttgttggcactgttacttgtgattacaaggccctgaattcataaacttagagataaaaaacttcctcgagctttgaccttttcagttacttaatatttttcaaaattcatatcatgcacttgtactccaattttaatctctttagggaacttacatgatataattaaagacttgaaatactctcctgtgtaacagtagatcagataaggtacacagtatgttttatcttttataatcaccgctttaatagcagatgtgctattaaataggaaaagtgcccttcacgtgccattttataattgcatattataaaatgatcacacccttaactcatcctctgcaatttctcagtagtatggcacttgacaaagcacttgctctcattcttcataataaccccatgaaggctgcggggcatttttgtgttgttgctgctgtaagaaaacaggtttgattatctaactgatggaatttatatttatttaacctatttttaggaatgaccccaagttgcatatattcggaagcctgcatttaatgttttaactgtttttctattaagtttactgatttgttataggtttgcaactctcagaatattttgtttatattagcagggcattgagattgtttattctaaatgcatttttttgttttgcaatcttataggccctggcctattttgagcagttaaaaatttccccagatgcctggcaggtgtgtgcagaagctctagcccagaggacatacaggtaattaaaaacaaaatttgcatgacaatttaaatttctgtggacatgacaggactgtgaaatttacctgtatttggaaagtgttttcataaaaacattttatgacttttttttttttttgcaaagccattaacatatagtcattccatgtagaaatgagaaaagtagtaaacccagtttggccatttcagaattaacttttcagtaaaaccatcctttggtatatattgtgtacctgtcaccagatcccagctggaataaagtgcagtaaaaacttccttatcttatgattgagggtgataactgctttcctaaaactttggtaaagacggtgattgtaaatgatatatatcttaattttaaaattatttatttattttattattattattattattttcttgagatggagtctcgctttgtcgcccaggctgaagtgcagtggcgcaatctaggctcactgcaagcttcgcctcctgggttcttgccattctcctgcctcagcctcctgagtagctgggactacaggtgcccatcaccatgcccggctaatttttttgtatttctttttggtggagacagggtttcactgtgttggccaggatggtctcgatctcctgaccttgtgatccgcccgtctcggccttccaaagtgctgggattacaggcgtgagccaccgtacccggcctatatcttaatttttaattttaacttaaggtatataatcattcggtgaccaatcttttaatattggaccacagtctttatctttgtatactaactagcattcactttattcgtaggttggtcacacctgtaacccatcctctacaatttctagcatgggtctctgtacaatgagtgacgatccatagatttttaagatatttgtccccgcctctcaagtcttctggttatataggccatgtcaaatatgtacaagattttttccttctgcagtgtggctttctatgaaatctttctaaagcattcaactaactttttacggaaataggaactctcttatactcacttcattggcagattgttggtctctagaagatctttgtcagtgtttatagctggctaactgcaactctgccactcccctagaaagacagttggaagtgggtaattggtgtgttgacttttgcccccatcttgtataagcaagggtaccatatttgtaatttagtgtcctgtacgaaactttgaagttggactgacagtccatgtggccctgcttgttttggatttggctacaatagaactactggggttgaattttaagcaggacttggacgaccatctttactttcactcagactctgtctgttctgccatttgtaattttacacctaacctgttattgtaaaatgaagggactgttccaggaatcttaatatctggaatttagagggatggtttgctgcttacaaagcattgtattcaaggtgcatcttaatatcttggttagtttgcttgtcagatttaatggaaattttaaatattgtgtaatatttagagttctcatagctttttaagtaaatggattttaatgtcataaaatgagaccagtaagtatgaaacaagccaaaggtctagtttgagaaacttttctgctgtattactcattactattttgcctttgatttgttttcctcagttcatattctgcttatctcattttctttttttctttttcagtgatgatcatgtgaagtttttctgctttcaagtactggaacatcaagttaaatacaagtaaggcttttcttactgttttgactcagatttgcggggagaggtcatttttttaatttaatgtttttcttccataaggaaaccataatacaggttgtaaattcacagtgtatatgttatatccaggttatagatacgttttgatgtaccccaaagtgttttaaaagtgctgagttggccaggtgaggtggctctcgcctgtaatccgagcactttgggaggctgaggccggtagatcacttgaagtcaggagtttgagactaaccagcctggccaacatggtgaaaccccgtctctacaaaaaatacagaaactagtcagatgtggtggcatgcacctgtaatcccagctactcaggagactgaggcacgagaattgcttgaacctgggaggcggaggttgcagtgagccgggatcacaccactgcactccagactgggtgacagcgagactccgtctcaaaaataaaaaaagtgctgagtttgttggttacacataaaaatccaaggctgggcgcagtggctcatgcctatgatctcagcactttgggagtccaaggcaagaggatcgtttgagctcaggagtttgagaccagcctaggcaacatagtgagacctcatctctacaaaaatttttttaaaaaattagccaggcatgattgcgcgcttctgtattcccagctactggggaagctgaggccaggaggttgaggctccagtgagccatgatggtgccactgcacttcagcctgggcaatacagcaagaccttgtctcaaaaaaaaaaaaaaaaatgaaaatccagatatttcacagaaaaatctagatttccagcttttctggaaaagtcagaatatctggtaacaccaggcctgtttttctacatgacaattctctcttagagttaagtagctgcatgggcacttgtgttcagaatctctgacttactaattaagcaaaataacaaatcactactgagaggattcctagttcacctattggtttattctgtagatcacagaccacaaaacattttcattcgaaaaattgtgtagccatcatttgtttcaacatgaacagaatcacaaattaaagattgatattgatgccctacctgccactcttgtccttatctttaaagcaatgatgagtggcattatcagtttatgttagggaacttcagataattgagagctatacaaattttccctttcaaatatatgaggctgttattttttacaaccatagacaccaaatatagccattattctttttcttctctattttgaacagatactcagaactaaccactgttcaacaacagctaattagggagacgctcatatcatggctgcaagctcaggtaaaatcataatttcattcagtacctcaaattattagatatttaaacttattttttgcaagagtttggaactttacctcaaagattttcatcagtgttcctccatttgatttcatagcttttttaaaaggtgctggttttaaagatcatggaagtggtagtttagcaataatttaatattatatcaatgactgaaatggtcatagtttccatgacacattgtggaaactttggttttaaaatgtagttgtttttaactacttgacaaatgctgctttctgtttggctcttaaaggtgagccctcctggacagcctctccaccagagccctttataaagggccagttgagttcttttcagttaattttagctaatcttaacacataaagcagttgtgtagctagagttttcattttccttaaagagcaagtagaggaaaatttttttttcttcttagaagaaattataggaactattaaaactctgcacatgaaacttttctgtcaaagtgtaagaatgaggaataatcattacagcctttaatggttcatttaattgttcttcatctggtcaatcacttaaatacttttgataattttgataatcataattatcaaaataattttgaagagtatttgttgcatagtttatctgggccatgttgacatttgatgaaactttgccttttaataagacaactggtgtttctgggtcttttcaatttacatttaattttatggactgtttctctgtttgtcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggcaagtaactaaccatgaattttttatatttaatgtaagttttgtaggtgataatgggcacataataaaaagagcagggaagttttctttcttgaggtaaactttcttaagttatataattataaatttacctgatgttttggattttattttatgaaggaactcaaacttggttattttttttccagaggtatattgaaattaaagtattacattacattttttatttttttacttttttgagacggagtcttgctctgttccccaggctggagtgcagtggcacagtcttggctcactgcaacctccgcctcctgggttcaagcgattctcccacctcagcctccctagtagctgggattataggcacatgccaccacgcctggctaatttttgtattttttgtagagattgggtttcgccaggctgtgctcaaactcctgacttcaggtgatccgcccgccttgccctcccaaagtgtggggattacaggcatgagccactgcgcccagcctaaattttttttaactaggcaaatactgtagtgacatacacgagttgattttcttttatgaatctgttgagaaaggtagtctcaatttaatactgctatatagtccctgagcaaggaagaagcattgcttaggagttgtccgtgttgctacttctgtattcttcatcacatagtgtaagtactatgttactatattgagaaataacttaaaatatgcttaagatttctaagcagtgctttttatagtttgtatttactaagaaattaactctgacactgaggagtagaacagaaagaggaaatacaaagaatcacaggatatgatcttagagctggtaaataggaaatactggtagggaatgtgttaacaagtctgaaagtttactctctgcaagtatattcagatatcaaacatgattttgtaaggtaatctactttgcatttggcgttttgtattttaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtaagtatgcctattatttttatagtataaacttgtaaaatacagtatctaaaactcatgactttgaaaatgttacaattttattgtcccattaccaggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggttggtaaatttatataaaacattgtatgtaaagttgttagaacaaactgggataggtactaagttaaatataataatagctttttttcttctaaatgttataaactccccttgagattataatataaaccactgcatctagccaaaatgttctcagtagcattctccttggagaatgggttataccagttcttaaacctgaaagcctgtaattgcacatttctcacaaactcttaggagatgctgacacaacttgttcatagtggaattgagattttttgttttgttttgttttttgagatggagtctcactctgttgcccaggctggagtgcagtggcacagtctcggctcactgcaacctccgtctcccgggttcaagtgattctcctgtctcagccttccgagtagctgagattacaggcgcatgccactacacccggcaaattttttacctttttggtagagacggggtttcaccatgttggccaggcttgtctcgaactcttgacctcaggtaatccacccacttcggccttccagagtgctgggattacaggcataagccaccgtgcccagcctggaattgttaaatatatgacgtcattttaaaattgaatcctgtaattagcacttgattcatattaaagttcagtttttcctcttagcttgggcaggcagttttaaacagagatgtgtcttgattgcttataggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacaggtaagtttttgttttattctttttgctcaatacataatacaaaggagccatggagaagtggaaaatatggaaaaattaaaaatgagaaaatacccataattctactacctaaagatatttactgttaaatactaatgtatttccatcttaaaaaaaaaagaattggccagaaaatagtttcaggttctaaattcagtagactaaccagcttcagaggtagttataggtttaggtttttttttttattttgaacctgtctttatttgtgaatacagttgaaattttcataagcatggtttgttattttaatttacatatacatcattcatttctcataaacaatttttttttcttttttgagacggagttttgctgttgttgcccaggctggagtgcaatggcgtgatgtcagctcaccacaacctccacctcccaggttcaagcgattttcctgcctcaacctcccaagtacctgggattacaggcatgcaccaccacatccagctgattttgtacttttagtagacagggtttctccatgttggtcaggctggtcttgaactccctacctcaggtgatctgcccaccacagcctcccaaagtgctgggattacaggtgtgagccaccacgcccggcaacaattttttacaattaaagtttcccccacttccagaaagaacttgtaggtggtgttagtctccatattatagcatttagcaattaaaataattagtaacttatcaatatgatattagatgaaagccatttctgtatatttactttgaattaattgagtcaagtcaaacttaaaatatgttcccaaatgactttagtttctgttttattgtagtaaacataacatgtatctttatgtatacttcaagaaattttatgcagtgtggaaaggtatgatcactattggtaattccattgtatatctcttaatggttttgtaggcttgttttgctttgtttaaaaacctttgcagaatatgttataggtgtctttgtctacatgtcaagttacttactagaagtggcattacttgatcttaggttaggtatattttaaatataggcagctgctgctaaactgccctccaaaaaagttgtgtgcatgttttcaaagatcttgattgattacaggccaggcataatggctgtcacctgtaatcccagcacttggtaaggctgaggcgggaggattgtttgaggccaggagtttgagaccagcctgggcaacataggaagactccatttctataaataataaaaagaaaactagccaagtgtggtggcacatgcctgcggtcccagctaacttgggagggtgaggtgggaggatctcttgagccagggagttgggggttgcagtgagccatgactgcgccactgcactccagcctgggcaacagagcaagaccttgtctcaaaaaaaaaaaaaaaaaccaggtcttaattgattcgaaaaatgttctgatatgcaggtataactttagaaaacctaataagttattgcttcctttttaacagcttacagtgctctcggatcagcaaaaagctaatgtagaggtaattgactttatgcttcttttaaaccaatgatagatttttagtctgtaatttgccttgaaatgtagcttaatttcaaattatatcaaattagaaggagactgacaaaaactcttttattctcaattttattcttaggcaatcatgttggccgttatgaaaaaattgacttacgatgaagaatataactttgaaaatgaggtaagaatttttttttgttgaggagaaaggagttttaattttattattatatcaaattaatatttcaagttcttattgtttcggggccctttaaaacatgaagttcttgaaaaattagtctgtttatattgacaccaaccttgggtgaaattaatagaagcctcttaatccttcctttttgatattttatccattaacaaccaccccccctcctttttttttgctttgagacagagtctcactctgtcacccaggctggagtgcagtggtgccatctcagctcactgcatcctctgcctcctgggttcaagtgattcttgtgcctcagccaccttagtagctgggattacaggcatgtgccaccatgcccggctaattcttgtatttttagtagagacggggtttcgccgtgttggccaagttggtcttgaactcctggcctcaagtgatctgcctgcctcagcctcccaaagtgttgggattataggtgtgagccactgcacctgtcccattaacagcccttttacaaatactgtgtagcactgaacatagtaaaatattgataatattattggtgatcatatttcactttatattttgtaagaatgatgaactccagtcacaagactgtattggcagagtggaaatgaggcgctctagacttgttccagttaaaggtctttttcaagattgtgagtgggtcagcttcccatcaaacaagggccattggtgctttctaggtattcagtcatggtatttgctgctaagctttgttctaaagtgttgtattcccccacctcagacattcaaaaacttagggttgtaaaaggataatagtggtgctgaccaacacactgcgcacctgggatgtgccaggctcctaagattgaatatctccagttataccatattattaccactttttacagtggatattgacttacaagaataaataaggtgcaaagaattcaaagcccattctagtgctagagtattgtctttaaccttcttagactatttctagctctaggcttttgaggtctacggctttgtgcagaaatacttatttgtgagctggagggaagaagttattaagcttaataagtttttctatataaatagtgacaaaaataaaagtacgaaatatgtaaatgcggaaaaatacaggagaactggatatttacatgaattttaaggtcttttaagtttttaatttttattattatactttaagttttggggtacatgtgcagaacgtgcaggtttgttacataggtatacatgtagccatggtggtttgctgcgccgatcaacccataagttttttgaatgaggattttaacctgtatcatagggtgaagatgaagccatgtttgtagaatatagaaaacaactgaagttactgttggacaggcttgctcaagtttcaccagagttactactggcctctgttcgcagagtttttagttctacactgcagtaagtttgtcattacttttgtaacaagcctacttctttcttttgctctttgatatgggtcaaaataaatgattcatatgacttattaatccatgttacttattgagatcttatgtgtatctctggaaacaatgcacttgtcttcttgatttatcttgatcctttctacctttgtgatgtattgcctgggaaagttaacagttgctatgactttttaataattaaaaaggcttttgttggtgtcttaccctgtgcataatttgctgtatgaaaaatttatctttaaatctcactgacatattataccttggtaggaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactgtaagtatactggagataattttgaccataaatttctgttttcagtataagctaatgggagttccttaattgttagagcttagtatatgttaataccggggcattttgatgttgcaataaataagaagaggtttcctaactttttcctgatctagctggtaacatcaggagtcagttcctatcagcatacatctgtgacattggagttcttcgaaactgttgttagatatgaaaagtttttcacagttgaacctcagcacattccatgtgtactagtaagtactctggatttttgttactttccatgggtttcagctaatgacttgatagtgtagtattgtatttttctgtctataacttttctcagaatcaaaacctctcagaagtgcttggcacacactgaaagtaacccctcctccatttcttttaaatggatagtttgtgcccaattagtcaactaaaacaagttctcaagggactgtttgtgtgtagtttagaattactcgtatattcctagtccctgccttttaggagctaagaagtaaaatttggtgtgaacaaaaatgtagcaggacaatatcaacaaaacccttgaaaaaatgcagaaatagtaaaagtgtctccttctttagatggctttcttagatcacagaggtctgcggcattccagtgcaaaagttcggagcaggacggcttacctgttttctagatttgtcaaatctctcaagtaagtataaaattgcagctattatgtttagttattttttaagttactggatagatgtaaaacaatagtaaagacatggaatcaacctaggtgcccatcagtggtggattagataaagaaaatgtaggccaggtatggtggctcatgcctataatcccaacactctgggaggccgatcacaaggtcaggagttggagaccagcctggccaacatggtgaaaccccatctctactaaagatacaaaaaattagctaggcatggtggcgggttcctgtaatcccacctactcaggaggctgaggcaggagaatcgcttgaacctgggaggtggaggttgcagtgagccaagatcacactccagcctgggtgacagcgtgagactcagtctcaaaaaaaaaaaaaaagaaaaagaaaatgtagtacacatacatcatgaaatactaaacagccataacaaagaacaaaatcatgtcctttacagcaacatggatgcagctggaggcctttaatctaagcaaattaacgcagaaacaaaaaaacaaatgccacatgttctcacttataagtgagagctaaatcttgggtacacacagatatgaagctgggaacaaaagacacttgggactccaaaatgagggagtggggcaagtgctgaaaaacttcctgttgggtactgtgttcaatatctgggcaatgggattggatcaatagaagcgcaaacctcagcatcccgtgatatacccgtgtaacaaacctccatgtgtaccccctgaatttaaaatgaagatggaggcctggcgcggtggcccacgcctgtaatcccagcactttgggaggctgaggcgggtggatcacctaagatcaggagtttgagactagcctggccaacatgatgaaacccggtctctactaaaaatacagaaaattagccgggcatggtggtgggcacctgtaatcccagctaacagaaggctgaggcaggagaatcacttgaacccaggaagcagaatttgcagtgagcagagatcgtgccattgcactccagcctgggtgacaagagtgaaactctgtctcaaaaaaataaaatgaagatggaaataaaaaaaaagtagacatataaattattttccaagagcctatggtagatttggttcttcctgttcaagtcaagtcatgctttgtcaggtcaggtagatgtactcccgacctttttttttttttttttttgagacagattttcgttcttgttgcccaggctggagtacaatggcatgatcttgactcactgcaacccctgcctcctgggttgaagcgattctcctgcctcagcctactgagtagccaggattacaggtgtccatcgccacacccggctaattttttgtatttttagtagagatggggcttcaccatgttggtcaggctggccttgaactcctgacctgagatgatccaccctcttcagcctcccaaagtgctggtattacaggcatgagccaccgcgcccagccccctttttatgttgccacttcctttcctgctcatcagccaagtacttagttcaatagtaaaagttttcattgttttttgttgttatttttttgagatgggggtctcatgctgtcgcctaggctggagtatagtggctggatcccagttcactgcaacctcaacctcctcaggctcaggtgatcttcccacctcagccccctgagcacctgggactacaggcgtgtgacgatggccggctaatttttgtattttttgtagaatcagtctcaccacattgcccagcctggtctcaaattctttagctcagtcttcccacctcggcctcccaacgtgttgggattacagaaatgagccactgcacttggcctgtattattctttactagtactattttttgcgaatgaaaactactccttattaggtttataagattgtaagtcattttgacaatcttatcactacagagcagataaaggtaatttttaaaaattaaccatagctaatcttaatcagaagtgactagcctacaactgaacttttttttagttctgtcttaaagggggaatttggtattttagcactgttttgagcactgttattaattgtgatttcctttttctgtttttcagtaagcaaatgaatcctttcattgaggatattttgaatagaatacaagatttattagagctttctccacctgtaagtatctgtctctttaagatattttacccagaattcattgaagccacacgtgccattagccttgcctttgttggcatttaaaaaaaaaaattggtggtggagggaagtgtatgtgcaaagattagttctatttaccaaaattctgttgacatagtaaacaaaacatagtaataggaatcaagagttgacagatcaatttggcagcatggggtatattgttaaaatgttgaagcattttatgaagaagaaaaaattcattaaagatgagcttgctgttaaaatgaaaagtatattaaaaattttaaaaaccaaaagaaaataaaaatttaaaaaattcaacttctaaattattctgtttaatcctataattgtattagccattcttagcagctgctactgttagatcgaaggttttccctgtcatttcaggcttagggtaaaaaaaaaaattaagtgctagtcgatctgaatattttggtgttgggattgggccataatcccaagtgttaaaatcctgaaatcctaaaaaccacaattctaaaagatcaaaatcttaaaaatataatcctggaaaaagtaattttaaaaaattatttgaaagatattactttacatttttaaaagggaatgtatttgagaaacatgtaaaaacatgacagcacttcataggccactttacacaataaaataggcaataataacatgcttttgcaagcataaacagttataaaaatgacagttacatgtgtaaaacaggagcagacaaactgtattcataaatcagaaagcaaaatgtgtaagtgcatgtcactatggttagtagttgtgtgccactctgctttataactgcgctcatctgaaataaccatgacagacaacctaagtcttgaggaaattgataaaaaacggcaatgggtcactacaacatatgcagtcacccaaagaactgagatcacaagaaattttatgtttcacagatgcagatgtacagaaaggacctttcttgtgtacatgcagtgtttacacacacagttaatgctgtgtgtaatgtacttttgcagagtcaaatttctgatgttcaaggccgcagaagaaaagtctgtccacctttcagagagagaccaatttgccttatgtatttgttctctcagagcccctggtcaattggatggtgcccgccaacactgagggcaggtcttccccacatagtctacttggactgactaatctttcctggaaacacccttacagacacatgcaaaataatgctttactgtgtgttgttacttaattatttaaaagaagtatagcactctagtacttttttttttttttttgagacagagtcttggctctgtcacccaggctggagtgcagtggcatggtcttgactcactacaactctacctctcaggttcaagcagttctcctgcctcagcctcccgcgtagctgggactacaggtgcgccaccacacccagctaatttttgtatttttagtagagacagggtttcaccacgttgaccaggctggtcacgaactcctgacctcaagtgatctgccggcctcggcctcccaaagtgctaggattacaggcatgaaccaccacatgcagcctagcctcataacaatcttatataaataagatctttacaaaagaaaacaagttagaaagctaactttaataattatcttacatgatcatttatagagtcttgtcagggctggaattagaaccgtgatctgttgacctctaatttagttttcttttcattctatggtcctgggagaaaatttgtctttataagtatttgacatatgagttggtgtgatagattacatttcctgttcctaatgcactttttctcattaaatgaagggaactcaaaaaataaaagctttaataagactgaatttcattctaggagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctctctagcagactgtcttaaccatgctgttggatttgcaaggtaagtgtgatcacagttaaaattataaagtgcatgtatctacacagacagaaccacttgtttggtgggcacacacatttgtgtttccacagttggataatccagagaattgtctaaatctttgtcctccaaatccagtcagttagatttggttgaagaaggggataggttacataccatttacatttttgccttgacaactgtaaatctttaactcctctgacttctctgatataaatgggttgtgtgtttaagaggatcagctgaagtgttaatataccaaatatatattgggacgggacatctttggttagtcttggttaccttaaagagaagagcgtgaggtttctcttcagttgtattgtgtcctgaagatcacccaagcagctgttttttccgcctctagccatactttttgttgacaaacaacagcatgaaagttgtaaagattgctaatttagaagttaaattgttctataatatatttaagaacaagagctagatattagagaggttgtataaagaattctgaagatggttttctaaatttaaatgggtggtttgcaggttacctagtacaggcctagtcataataagtggatttattttctcttttctgtccactttgtcagtaggatttttctcttttttttcttttttcttttttttgtgggggagacacagtcttgctttgtcactcaggctggagtgcagtgttgtgatctcagctcagtgcaacctccgcctcccaggctcaagcaattcttgtgcctcagcctccaagtagctgggattgcaggcatgtgctaccacacccagctaatttttctatttttagtaaagaccggttttgaccatgttgtccagactggtcttgaactcctggcctcaagtgatttgcctgccttagcctcccaaagtgctggaattagaagcatgagccacaatacccagcccagtcaataggattttaataaaacatttaggtagactcacattagaaggattatattaactacatgtcattcatttaagttaatttgagctcttttgttctggaaagatcattggaagcagtagtttacaaatagccatattagctaaagatggaagtaattgtgatgtggaaaataaaggtctggttatttagttttgttaattttgtaatttgttgtgcattgcttttgaatactccataacacttttaaagaataaagttgcatctgattgcctgatttttgcttatatagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaaggtaccgcaaactttcagagctctgaaaatctcttgaagatcagatgtatttatcttcagacatgtttcggattttgcccttgggtttctttttttttgcttttaatgaattacttaagagcctcatggatcatatgtatttttatcatctgtggtgtctggcacactgcctgatacataggtcatgcttaatagatgtttgaatataaacagaccctaaccgctttgtgtagcaaaagaaaactagtctgctgttttagaagagcatataaaaccagtaaactgagtactaaataagcaccataattcaggtacccaagcaagagttaaaagtaattcaatgtattaaagtcagttttctgtaggacatttaagctggctaataaaagtggttaatacttacatagtacctcttttttccttttttcttttttttttaaatggagatagtctcactctgtcacataggctggagtgcagtggcgcggtcacaactcactgcaacctccacctcccaggttcaagcgattcttgtgcctcagcctcctgagtagctggaactataggtgcatgcaccacaccacgctaatattttgtacttttagtagagacagcgtttccccatgttgaccaggctaatctcgaactcctgacctcaagtgatcctcctgcctcggcctccataagtgctaggattacaggcataaacctggccacttacatagtactttctatgttcaaaatctgttctaagcattttttgtacatttactcatttgatcttcatacctaccctagaagacagggattatatgttatagttgaggaaactgaggcatggagaagtgaagggatttgcccaagagttcataaaactcaggagttcatttgtaagcaagtattgagaacatgctattaaacaatgttttttacctttgttcaaaaacaagaaaaaccctaagagtttaatcatataattcattttttgagaatttaattttgaaaatattccatggcaatattgtgaaatatgtctgactattattttaacctaaatcttaagctgtaggaaagggtttaaatttaatgatcttgagtcttttagtaatattttttaaggttttttccccaccttgaaatggagtcttgctgtgttgcccaggctggagtgcagtggtatgatcttgactcactgcaacctccacctctcaggttcaagcagttcccctgcgtcagcctcctgagtagcttggactgggactacaggcgtgcgccactacacccagctaatttttgtatttttagtagagatggggtttcaccatgttgggcagactggccttgaactcctgacctcaggtgactcacccgccttagcctcccaaagtgctgggattacaggtgtgagccactgcgtctggcctagtaatgtttaggttatatagattttatcttaaaattgatatttgctaactgaattatgtacgcatgcatcctaaatagaaaagaaaggctttatgtaaaatagttttttctaagttgtatgttaatattgttactaatttctgaagtaatgattgtttatcttcagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgggaacacatgccatatctaatttgtctgcttaagtctgtgtcactgttgtacatctatatgaccaagagcaaactgaagtaaatacagaaattttgaagtttgctatcccatgggaagacagtttattgttttcagggtgggaattgatcacttttatgtaaagcacctaaaattaatttgtattctgttcctttttctttctgcaatatttttttaatttggttctttagcaatataaataacatggttacttaccagaattgacctgacaattgagtctttatggcaaatttgccattttgaaatataaaataaatggagctgtacagatttgtgtagagaattctgtataggaaatttagggaacaagataccaggggcaaactgatttttcattgttttattttttaatttgatttgatttgtgagatagggtctcactctcttgcccaggctgtagtgcagtggtgtcatcacgactcattgcaacctccacctcctgggctatcctcccatctctacctcctgagtagccaggaccattggcagttgccacaatgctgggcttattttttgtagagatgggatctcaccacgttgcccaggctggttaaactcctgggctcaagcaatcttcctcggccttacaaagggctggaattacagacaggagccaccgcgcccagctgatttttcagtgtttaatgtttaaactttaggtgcccagttaataaaaatcaagggattttggcaattctgtaaatgcttttttcccccttcatttttcccattccacctgtaaatgatttttgacttgttaatgtatatgaaaagagaacttcaggttgctttcctagttaattttggaaattgcttaaactaaaggtttttctcctcaggtgcagagaatgtagaaagagtgttggttactgttatccaaggagcagttgaatatccagatccaattgcacagaaaacatgttttatcatcctctcaaagttggtagaactctggggtaagataattttatttcttaaccttcatttcccaaactctttcataaaactcttagacataatggaacatagccctaacagagagagaaactgggagttggttttccctggtgatgaattaattgacttacttttatatataagatgaaaatttgaattctcttgacaggaggtaaagatggaccagtgggatttgctgattttgtttataagcacattgtccccgcatgtttcctagcacctttaaaacaaacctttgacctggcagatgcacaaacagtattggtaagcacctaggaatctttgtttaccttgtgtagctcatatattcccaatttcttctttaatgccaggttgattatattatgtttcattgattttttttttaacttagtgatttcagatcagggttctttttttaaagatttatgataccttctggagtttttatgaattcttattgaatcccaatgctactgctgaattttacaaattctactccttcgactttaacacctgactttttctaggaccatgaaagggcatatgtcacaaacattctttcaagcttgagtattagtttcctactactactttaattctaaaacttgtacctagtggttttccctaatcattaagagcatgaaatggcaacttgatcctccttgtatgatagtttccccaaatctaattttcacaatacttaatgtcaatttccgctttctcactttcccacaacctggtaaaagctagatttcataattgtaatttactacgttaaaacaacagtttgtatttttctgttttttttctttttttacttcaacccacttagtccatctgcctgttacctttccttcctctatcccttctctggagttaaatatttctctggaaatatttatttgaatttccctggcagtggccagggtagtaaagagaagagctggatcactaaacaagaattgaatatatagaaattcttaaacttgtttttcacaggctttatctgagtgtgcagtgacactgaaaacaattcatctcaaacgggtaagccttttagtccatgccccttcattttcatctcacatgtggtattattatcttgttcttgaaagatgtatcttgtgtaaaatttaacttttgttttgactttttggatgtggggaaaggggatgaatgaaagtagcagtatccatttattgtccttcatgttttgggtaacatgttttggtttgactaaggatgtgaaaaatcttagccagaatttcaagattcagttttcatgatcttgtaggcttcttcactaccagattttttattttatttttatttttatttatttttttgagactgagtttcacttttgttgcccaggctggagtgcagtggcatgatctcggctcacggcgacccctgcctcccagattcaagcaattctcctgcctcagcctcctgagtagctggaattacaggcacccgccaccatgcccggctgatttttatattgttagtagaaacagggtttcaccatgttggccagggtggtctcgaactcctaacctcaagtgatccgcctgccttgcttggcctcccaaagtgctgggattacaggcgtgagccactgcgcctggcctattttttatttatttacagggtctcactctgtcactcaggttggaatgcagtggtgcaatctggggtcactgcagcctccacctcctggagtctcaactgatcctcccatctcaatctccagagtagctgggaccacacagatgcatgctaccacacctggctaatttttatattttttgtagagatgggatttcaccatgttggccaggctggtattgaactcctgacctcaagttgatctgcccacgatggcatccaaaagtgctgagataataggcgtgagccactgtgcccggccttggttatttttttaatatatattttactttattttttgtggtaggttctccctgtgttacccaggctggagtgcagtggcatgatctcagctcattgcagaccccacctcccaggctcaagtactcttcccacttcagcctcctgaatagctgggagtacaggcgcacgccaccacacctggctaatttttgtggtttttatagagaccaggtctcaccattgtccctacactggtcttgaactcctgggctcaaacattcctcctgccttggcttcccaaaatgctggtattacaccatgcccagctgattctgggtatttgtaaataactggaattggttgccaacatttaaaaatctcaaatacttttttttaaccaaaaattcttccctccagcctctctcaaagccatagaatgccagcacaggactgttattgccacatagctacagccagctaaagagcagtagttgccctcaccccctaaaaagaacatgagcttttgctcagtggtctccattcagctgtgcactcatttgaacttgattttttgattctgatagagacttgaagtgttttcaattcagcagcatttcttctatacttgctacctgctagggtggggtaggtgtgtgtttagggacagcaggggaactgtataaaggtaaataaggcatcccccgatactcgagaactcagaatcaagggagaccaacacataaaaaactccagtgggttaagtactttagtggagatacataaaatattgtggaactaaagctgaatgggcaattttgcctgaggggcaatctaagcaagctataggaaagaggtgatatttttgatggcccttaaatgtagattgatgggagtaatagggagctggcattctgggcaaagttaagtaggtgtacaaagacagattagattagatgtcacatggtggatttggtgggaagttatagacttaattctgtttagctaaagtatagaggcagaagtgatagctaaaaaataagatgagactagataaaagccttgtgttacatgtgtaaagtcaggaagtcagtaggcagtgggtttgtaatttaggagggaaagtgttcggaacaatgggtctgaagcagttaggattaaatactgattttggagtcctcagtgtaagtcagtcaaagtaaagccataggaatgactgagactttctaagaccagaacagaaagaactttggctcaagcaagagtcaacagaaaggtagaagtagaaccagatagtcaggtgtggtggtgcacgcctgtaatcccaactacttggcaggctgaggcacaagaattgcttgaacccaggaagtgaggttgcagtgagctgagatcgtggcactgcactccagcctgggcaacagagcgagactctgtctcaaaaaacaaaaacaaaacaaaatgaaaaagcagaaccagaggtaggagcattatgaaagataagagaagacagtctcaagagaggagattggatggcgttgtttggatgctaaacagtcaaggtggatgtggatgaaggatgaaaggaaacagtaaggatggtatttctacttcagaagtatttgttttatccatagaagtcgtaatttaaacatacagaattgagtcaaacaatattttaaagtgttttgcttcagaaaacaaaaaaaagttttgcttcattgttcttttttctcatcttttgactgacttgaggtataagtttactttccctgattcaaaacaaacaaaactacactcttttaaagtgataacagtgaggttacaaagtgatgaacattgcataggaagcaagtacagacagggtagacataagaaaaagatgagaaggaaagtaggagggatctgggaaacagtgaagggttactgcctctcagttacagacaggtttcctctgatgggtcattaaactgggacttagatccaaggtgaaggaggaaacataaatcctttgattcagaagcactaatattaaacaggaattccaggtggtagtgcaaggaagagtacatcgaggagagatacattgatttttttttttttttttgagacagagtctcgctctgtcacccaggctggagtgcactggcataatctcggctcactgcagcctgcgcctgccagtttcaagtgattctcctacctcagcctcccgagtagctgggattacaggcatgcgccatgatgcccagctaatttttttgtatttttggtagaaacagggtttcaccatgttggccacactggtctcgaactcttgacctcaagtgatcacccatctcctcctcccaaagtgctgggattacaggcatgagccactgcacccggccaagaaccttatttttcagatggagaaactgaggcttagagaggttaagtaacttgcccaagtgcagcaaaccaccagggcacatgtatacctatgtaacaaaactgcatgttctgcacatgtaacccagaacttaaagtataattttaaagaaggtgccagagccaggcttcaaaccaaggcagtctggctctcgggtctgtgttcttaagcacaatactatattgcctttaaagtgtacatgtattgttccgattctttttaagcttattaatgtcaagcaagaaaatagttgtaagtatcttttaatcttcagggcccagaatgtgttcagtatcttcaacaagaatacctgccctccttgcaagtagctccagaaataattcaggtaagagctatttcttaccattgtgtaggcgagagatcacagtagtagcagcattgcctgtgacattgtcgctagcagaaatcaaaaatattttcatattacataagttgttgccagcatctcaaaatactgtttatgcttatcaccattttgaaattatgagttactaagtaatatcactacaccttgttacccaacaagttaataagtccttactgttctagcatactttagtttgataaccattattcagtataattggcttctatcgtaatcccatgtattatgttttatgcatttttttaaaaaaacattctaaaggagcctaataggcttttccagactgctgaaggggaccacagcagagttctgaagctttgtaccaggtagttcattgtgtgtacaccaagcttatcaatgcttaatctgtaaatctgaaactattttaaggaaagtgtctggaaagttaccttatacttttaagaagtcatttgtataatattgtttcttggcatataattttccagatttcttgtccagtagtacatggagttaatgaagtatcaaacttgattaaaactagaattacaatctcttatgtagattccaaaatttgtttcttcatcaatagtgtttttattttattgtaagaacacttacatgagatatataccatcttaacaatttttacgtgcacaacacagtattattaattatagggacagtgatgtgcctataaaatataggtggatctccagaacatattcatcttgcataactaagactttatacccactgattagcaattcccatttcccacagcccccatctcctagaaactaccattctactctctgattctgtgaatttgactactttagatacctaatataagtggaatcatgcagttatctctctttttgtgactggctgtttcacacaatgtcctttaggttcatccatgttgttacatatggcaggatttcgcaattttttaaggctgaataacatgccactgtatgtatatatcacattttctttatgcattaatccactgatagattcattggggctattttcacattgtaagtgctacagttaacatgggaatgctaatatgtctttgagatgctgattccaattcttttagataaatacccagaagtgggattgctggattatatggtagtcctatttttaattttttgaagaaacatcttactattttctatagtggctatacaccattttgcatttccatcagttgtgtagcagggttccagtttttccacaatgtcaccaacacttgctgtctttcatttttttgtaatagccattctaacaggtgtgaggtgatatctcattgtggttttgatttgcatttcccttatgattagtgatgtttgttttttcatacacctgttaaccatttgtatttggagaagtctattcaagtctttaccccattttctaatcaagttattaagttttttgctattgaattagaggagtttttttatatgttagaaattaaccccttatcagataaatggtttgcaaatattttctcccattctttagctattccagaggttgcctttctgctctgttgattgcttactttatggtgcagaagcttcttaattcaatgtagccccactaatgtagcttttcgtgatatcaatgaaatcatttcaaagaccagcatcttgaagcttttctcctatgttttcttctagttttgcagtttggagacttacatataaagtctttaatacattgagttgatttttgtgtaagataagggtctcgttttcttttgcacgtagatatccagttttaccagcaccattattggagagattattgttccccattgtgtattcttagtacccttgttgaagatcagttgactgtatacaggagttgattttcaaattctattttgttccattggtttatatgtctgtcttaaaagagagagggtctcactctgttgtccagactcaagtgcagtggcaccatcatagttcacagcaactacaaacgcctggactcaaagaatccttctgcctctgcctcccaagtagctaggatatatgtctgtcttttgctagtaccatactgttttcacactgtaatattaaaatatattttgaaatctggaagtgtggtacatccagctttgctctttctctggattgttttggctattcagggccttttgtgattccatgtaaattctagttttgttttttctatttctataaaatatgctcttggaactcttatacggattgccttgaatctgtacgtcactttgttttttatttttggaatgattaagaagctttttaaaattttttaaatttatttttattttttttgagatggagtctcgctttagtgcccaggctggagtgcagaggcacgatcttggctcattgcatgcaacctccgcctcccaggttcaagtgattctggtggctcagcttcctgagtagctgggattacaggcaggcaccaccatgcctagctaatttttgtttttgcttttttttttagtagagaccaggctggtctcaaactcctaacctcagtgatcttcccaccttggcctcctaaagtcccaggattacgggcgtgagccaccttgcctggccattaagaagcattttgttgacctgatggaacagggatattcatttagcagctcagttttatatactctttcccctgtgtcattttacataatgtgtaaagtgggggggggacccttttattgcaaagacatttccagagtcgtcatctttttctttctttttgagacagtcttgctctgtcacccaggctggagtgcaatggcacaatctctgctcactgtaacctccacctcccgggttcaagcaattctccgggttcaagcagttctccggcctcagcctcccaagtagttaggattacaggtgcccaccaccatgcctaatttttgtatttttagtagagacggggtcaccacattggccaggctggtcttgaactcctgacctcaagttatccactggcctcggcctcccaaagtgctgggattacaggcgtgagccaccacacctgtccagaaccaggggcttttctgtgaccaaggtaaccccatatcaattaccctagcccatagtgtccttggaccttactgctaggcactggctttcagtgttgctttgtacttccctgtcgtctcctaatgccattaggcctggatagggcacctgccctttaacttcacaggtagattcccatcagaactactttgaaggccaaaatgagctgggtgagagagctgctttttctcctgctctcctttcttgtgtcctcattcttccccacgatttttttgatgtgttccataatctccttattcatcttgatttctatatccaccaggacctgctcttcataatataaatagaattgtaggaagggtaatggtattgtgttcttaaacatcatgatctgcatccaagggttttttgtttgtttgagatggagtcttgctctagtcttgctctgtcacccaggctagagtgcagtggcgcgatctcggctcattgcaacctctgcctcccgggttcaagcgattctcctgcctcagcctcccgagtagctgggattacaggcacccgccactgcacctagctaatttttgtatttttagtagagacagggtttcaccatcttggccaggctagtcttgaactcctgacctcgtgatccacccacctcggcttcccaaagtgctgggattacaggcgtgagccaccgtgcccgatccaagggttttttttgtttttggatttgaggtatgttgaaaaatacaaatttcctgccactgtcacccagctccccatgtgtgttataattcactcttatgaccttcaccaagtccctgaacactactacatcaccctggtctgggtattgcagaagggtaagggccccttcataggtggtggcagtcaaacaccaaagagaggtaagagaacagcagacatcacttctcggcagattgctttgggtagcaaagacattttaacaatattaagtcttcagtccatgaacacagctttcaatggtgtttttttgttttttatttttattttgagacagggtcatccactgtcgcccaggctagtgtgcagtggtgcgatcttggctcaccgcaacctctgcctcccgggtttaagcaattcttccacctcaacctcccaagtagctgggactacaggcgcatgccaccacacctggctagtttttgtatttttggcagagatggggttccaccatgttggctaggctggtcttgaactccagacctcaagtgatccggccactttgacctcccaaagtgctgggattacaggcatgagccactgtgcccagcctcaatggtgtttttttgaagtttttataatgctgtttttttcaaaaataaagatttcacatgagtttaaaaaatgaatttaactcatttttaatgaatttgtgatctcttatttcacagtataccacctttagagatattaatgactttcttggttatcatttgatatgtaaataaactcatattttaatgaaaataataaattactattcttgtgatcttagtgctcatcaaaagtagaacttagaccattcagtttacagctaatcttccagattgctaaatgaaataaaattatttttctatttagtaattcattatgaaagataaggaacctcagttttccctttttcatatgccttatgtctgacaacacattttgcacaatattctctattagaattttcttttcttttggtctagctctgtttggttatccctcttactagatgtgagcagccgtagcaatgtagtttttgtcccattcactcctctcaggcatgaatccaccttgtctaggagagctatgttctcaaaagtgaaagcagcctgtttgacaagtactgacatttgaaaatgctataaacctcttgtggtgagatactgtttgaattaatcttgataagttaaataccatgaatttgaagcaaccttaaattcctttgacagataaatggataaacaaaatatggtatatacatacaatagaatattaagcctgatttataaaataatcctgtcatatgctataatgtggatgaacctagaggacattatgctaaatgaaataaggcagttattaaaagacaatgctctatgattccatttgtttgagatatctaaagtagactcaccaaagcagaaagtggtggttgccaggggctggagtaggggaaaatggggagttcttcagttaagaggcaaaaagcaagcttgttttgcaagatgcaaaagttctagaaacctgttgtacaacagtgtgcatgtagttaatgcttactgtactgtacatgtaaaagtggttaaggtgataagttttaagtgtttttaactacagcttttttaaaaaaagagctgggcacagtgacttatgcctgtaattccagcttcttgggaggctgaggtgggagtgtcccttgagcctaggagttggaggctacagtgagctatgatcacaccactgtactccagcctagatgacagagcaagaccatctcttaaaaaaaaaaaaaaaattaaaaaaaaaaaactggatacgaattacaatggatttaatacaaatacatttgttctttttctccctcttttccccaccccccaggagttttgtcaagcgcttcagcagcctgatgctaaagtttttaaaaattacttaaaggtaggtatttgtgaagctcacgtatcttcatacaattaggtaatgtttgagagccaagagagaatacatacctgcaattatagatgtttatgtgaagtcccttttaactaagctcttgaaaaagagtataagttaggtaagcacactgaatgtgtacacctttgagtatattggtgagaaaatgccagttttcttttacagtttcatgatgtaattaaatagaaactagagggattaggagaataagaaatgttcaagaacagttgtccaaattaagttgaaaagaaggggctaaaaatataaaaacagaaggatgagatatttgcttatatcctattttgaaacatttgaactgtaaaacagacaaaaaggagaatcctcagatttgggccatcaagcctccttttacatttacgaaattactgatttttttttttaactctgtaaatcaacaaaaagtgtcacgtgtttatttggtattcatagttataattgagttcatgagatgaaactgtcttggtcttacctaggtagtcattcatttcatacataatgactgctttttatgtaccaagtactacagtaatggctgcaaatacaactatgagtaattttccctccccataaggagctcatgatctagaaataaagttacagtgtgacaaggtgaattattttttattatcttcactcaaataatttgaagacaaagcactgtattaaattcagtagcaggtaacttagtgtatcacctggttcttttagcaaagacattcagtagaatttgtaagtcagagggctttgcgcagtaaataatttaagtgtgccatcctttgactgtggttctaacatcttcccttgtcagttttttcttagttgtagtttgtcagcttaaacatctcagagtttttgtggaagaatattgagggcttgtttttgtttatcattgggaaccctccccttcgccatcctcccataaaaaagcaaagtgcctacaggagtaacccctgttaaataactgatcagtcaaactgaatttaaggactcagtcctcactatctgttagaggtgtctgtaacagtagatctaggtaccctatagaaggcttgttctccagatgtggttatttatctgcatagcatttataaaaagtcttccttctgggcccaacttctcttcagtgatgacattatcttagtgatcataattctcagtgttagcattattattctagttggaaaaaatgaatttcattcgtgttcactcctcccttcacatctgattgatcctcagatcttgcagattctttcctcatcttctctctcttctgtctctgctgctctggtgtaggctgatgttatcttactctgatctctcttctcttgttctagccaggctgatgtgtttgaaaacttcaagcagtcctttgatatttattcaccttcctcataaccttcctgaacaaattcatgtttctcagtttggcacttaattttttttttttttcatattctgccctgagactacctttctgttttttcttgcagaaatggtctttactgttcttgtagttcttcaaaaatcctgccttactagcagcccaacttctgtatgaactgtacccatttctctaggtttgccttaagcacagcctccttgtaaggttttcttttgcctatatagtgatcattctttcccctgcacatagtagattatctattaaatgaatctcctaggtactagggcactatcaatactgttcttgtctgtattagtccattttcacgctgctgataaagacatacccgagactgggcaatttacaaaatagctttattggatttacagttccacatggcaggggaggcttcacaatcatgtcggaaggcaaggaggagcaggtcacatcttacgtggatggcagcaggcaaagagagagcttgtgcagggagactcccatttttaaaaccatcagatcttgtgagacccatttactatcaggaaaacaacatgggaaagacctgcccccatgattcaatcatctcccacccggtccttcccacaacacataggaattatgggagctacaagatgagatctgcgtggggacacagggtcaaaccatatcattgtccttactgagaacactgaattatgtctggtgctcacctgacctgccatggatggcagcatgtagtactaggccatgcctagcacagcctctagccaactcctttgtagtctcaaattttgacttggaagtacttttgaatcatcaaataaatagtaaattccttacagagttagaactgctatgtttagctttgacttgtttcctcctcaatatttaatttttttttttttgagacggagtttcactgttgttgcccaggctggagtgcagtggcacgatctcggctcaccacaacctctgcctcccaggttcaagtgattctcctgcctcagcctcccgaatagctgggattacaggcatgcaccaccacacccggctaattttttctattttgagtaaagactgggtttctccatgttggtcaggctgatctcaaactcctggcttcaggcctcggcctcccaaagtgctgggattacaggcgccgtgcccgtcctcaatatttaatttaccagtgttaatttggaaatagtaccaatcagtaaaaaggtgtcaagagcttgttttcttctgaccacttgatttctatagcatagagataacaccatattttcactacttccccagttgggtgatgtcagcataagttatatctacacttaccaaactctccagaacagaaagttcttagcttggattacatacggatatataaggcatgcgaaatgttctaatgttacagaagaacattgctagcactcagatacttggagccattcttcaggtgaaagtgatatcttctgacattagtattgattgcattaatactttatttacaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaa

SEQ ID NO: 2613 - DNA, 615555 bp, Homo sapiens
cttaggttggtgcaaaagtaattgcagattttgctaattgaaactaatggcaaaaactgcagtaacttttgcaccaacctaatagttctttaaggaatctccacactgttttccatagtggttgtactagttcatgttcccaccggcaatgcagggatgttcccttttcaccacatttacaccaacatctattattttttgattatggccattattgcaggagtaaggtggcatcacattgcagttttgatttgcagttccctgatcattagtgatgctgagcattttttcatatgcttgttggccatttgtatatcttcttttgacaactgtcaattgtctatgcatgtccttagcccactttgtgatgggattttttttttcttgctgatttgtttgagttccttgtagattctgtatagtagtcctttgtcagatgcatactttgagaagattttctcccactctgtgggttctctgtttactctgctgattcttttgctgtgcagaagccttttagtttaagttccatctatttatctttgtttttgttgcaattgcttttgggttcttgatcataaagtctttgcctaagccaatgtctagtagtgtttttccaatattatcttccagaatttttatgattctgggtcttagatttaagtctttcatccatcttttttttaaattttattttattttattattattattattattatttttattgatcattcttgggtgtttctcgcagagggggatttggcagggtcacaggacaatagtggagggaaggtcagtagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctccaatgtctacctctttctacacagacacggcaaccatccgatttctcaatcttttccccacctttcccccctttctattctacaaaaccgccattgtcatcatggcctgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctcccggacggggcggctggccgggcagaggcgcccctcacttcccggacggggcagctggccgggcgggggttgacccccccacctccctccgggacggggtggtggccgggcagaggggctcctcacttcccagtaggcgcggccgggcagaggcgcccctcaccccccggacggggcggctggccggacggggggctgaccccccccacctccctcccggatggggcggctggccgggcggggggctgacccccccacctccctcccggacggggcggctggccgggcagaggggctcctcacttcccagtaggggcggccgggcagaggcgcccctcacctcccggacagggcggctggccgggcggggggctgacccccccacctccctcccggacgaggtggctgccgggcggagatgctcctcacttcccagacagggtggctgctgggcggaggggctcctcacttctcagacagggcggttgccaggcagagggtctcctcacttctcagacggggcgtccgggcagagacgctcctcacatcctggacggggcggcagggcagaggtgctccccacatctcagacgatgggcggccgggcagagacgctcctcacttcccagatgtgatggcggccgggaagaggcgctcctcacttcctagatgggatggcagccgggcagagacgctcctcactttccagactgggcagccaggcagaggggctcctcacatcccagacgatgggcggccaggcggagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcacgcctgcaatcgcaggcactcggcaagctgaggcaggagaatcaggcagggaggttgcagtaggccgagatggcagcagtaccgtccagcttcggcttggcatcagagggagaccgtggaaagagagggagagggagaccgtggggagaggaagaggaagagggagagggagagggagagggagagggagtgggagcgggagcgtctttcatccatcttgagttgatttttgtataaagtgagagatgaggatccagtttcattcttctacatgtggcttgccaattatcccagcaccatttgttgaacagggtgtcctttcctcactctatgttttgtttgctttgtcgaagatcagttggctgttaagtatgtgggtttatttctgggttctctattctgtttcattggtctaagatcagtactatgctctttcgatgactatagctttataatatagtttgaagttgggtaatgtgatgcctccatatttgttctttttgcttagtcttgctttcgctacatgggctctttctttggttccatattaattttaggattgttttctagttctgcgaaaaatgatggtggtattttgatggaaattgcattgaattttttattgcttttggcagtacggtcattttcacaatattggttttacccatccatgagcatgggatgtgtttccatctttttttggtgtcatctgtgatttctttcagcactgttttttacttttccttgtagagatctttcacctccttggttaggtacattcctaagtattttattttatgttttgcagctactgtaaagggggttcagttcttggtttgattctcagcttggtcactgttgctatttagcagtgctactgatttgtgtacattgattttgcatccagaaactctactgaattaatttatcagatctaggagctttttggatgagtctttagcgttttctaggtatacaatcatatcattggcaaacagtgacagtttgacttctttactgatttgaatgtcctttatttctttcccttgtgtgattgctatggctaggacttccagtattatgttgaacagaagtggtgaaagtgggcatccttgtcttgttccagttctcagggggagttctttcaacttttccctgttcagtataatgttggctgtgggtttgtcacagatggctcttattaccttaaggtatgtcccttctacatcaattttgctgagggttttaatcataaaggacgctggattttgtcaaatgctttttctcttgagatgaccacatgacttttatttttaattctgtttaagttgtgtatcacacttattgacttgcatatgttaaaccatccctgcttgatcatggtacattatctttttgatatgctactggatttggttagctagtattttgttgaggatttttgcatttatgttaatcagggatattggtctgcagttttcttttttttttgttacgtcctttcctggctttggtattacggtgatacgggattcatagaatgatttaggaaagattcccttgttctctatcttttggaatagtgtcaggaggattggtaacaattcttctttgaatgtctgatagaattcagctgtgaatccatctagtcctggacttatttttgatggcaaattttttattaccatttcaatctttgtgcttgttattggtctgttcagagtttctatttttatgctgttttatccagaaggatagtatatttccagcaatttatctatctcctctaggttttctgatttgtatgcataaaggctttcacagtagtcttgaacaatcttttgtatttctgtggtttggttgtaatatcccccatttcatttctaattgagcttatttggatcttctctcttcttttcttggttaatctcactaatggtctatcgattttgttaatcttttcaaagaaccagcttttcatttcattcatcttttgtatttttttgttgtttcatttaggtctgctctgatctttgttattttttctcttctgctgggtttgggtttggtttgttcttgtttctctagttccttgaggtgtgaccttagtttgtctgcctgtgctctttcagatgattgtaggcatttacggctatgaactttcctcttagcactgcttttgctgtatcccagcagttttgacaagttgcatcactattatcatccagttcaaagaatttttaaatttccatcttgatttcattgttgacccaatgatcatttgggatcagtttatttaacttccatgtatttacatggttttgagggttccttttggagttccttcatttatgaagcttagttcctctggatacaaaattcttggctgatgattgttttgtttaaggcggctaaagataggaccccaatcccttctagcttctaggatttctgctaagaaatctgctgttaatctgacagattttcctttataggttacctgatgcttttgcctcacagctcttaagattctttccttcatcttgactttagataacctgatgatgtgactaggtgatgatctttttgtgatgaatttcccaggtgttctttgagcttcttatatttggatgtctgtatctctagcaagaccagggacgtttccctagattattccctcaagtatgttttccaaacttttggatttctcttcttccaggaacaccaattattcttagatttggtcatttaacataataccaaacttctgagaggctttgttcattaaaaaaattttttctttgtctttgtcggcttgggtcaattagaaagccttgtctttcagctcttatgttctttcttttacttgtttgagtctattggtaagactttccagtgtattttgcatttccctaaatgtgtccttcatttccagaagttgtgattgttttttttcatgctgcttctctggagatttttccatccatatcctgtatcatttaaaaaatttctttaagttggtattcacctttctctggtgcctccttgagtagctaaataattgaccttcagaattctttttctggcaattcagagatttcttcttggtttggatccattgctggtgagctagtgtgatcttttgggggtgttaaagaaccttgttttgtcatattaccagaattgtttttctggctccttctcatttgggtagattatgtcagaggggaagatctgtggctcaaggactattgttcagattcttctgtcccacgggatgcccctgatgtggtgctctccccattcccctaaggatggggcttcctgagagctgtgatcgttgtttttcttctgggcccagccacccagcagagccaccaggctccgtgttggtactggggagtttctgcagagtctggtgatgtgatccgtcttcaggtctctcagccatggataccagcccctgcgctggtggaggtagcaggggagtgaagtggattctgtgatggtccttggttgtagttttgtttagtgtgctggttttgtgttggttggtttccagccagaaggtggtgctttcaagagaacataagctgtggtagaatagggagggtacaagcttgccctagggtcacctggataagtattcaggtttcttaggtggtgggcagggccacagagctcccaagagattatatcctttgtcttaaggtaccaggacaggtagagaaagaccatggtggtggtggggggcacccgcaggattaggtatgtctgaactcagactctctttgggcggggcttgctgcaactgctgtgtgggatgggaatgtggttctcaggctgatggagttactttcccaggaggattatggctgccactgctgtgtcatataggtcaccagggaagtgaaggaaaggcagtagttacaggcctcacccagttcccatgcatcccaaaatgccactctcgttcccactctacccctcagtagcaaagagtttatttccaggcagccagtgagcagggttgagaacttgccccaggctacaagcctcccttctgagaaagcaagcagggcttttaggttttgcaccttcccacctgctgtggattctgtgctcatatctgcactcctcatttgctccctcctttggattctgtccaggaaactttgccttcagttgaaattgttacagacttcagctagaagtttccttctccttgttgtctttcttcaattccactggcagccctccccaaggactcctgcaagacagtcaggaatgcaggaatggcttccctgaggaccaagagtgcccacagggctcttcccactgcttcctctacccctatatttcactcggctctctaaatttgtctcagctccaggtaaggtcaaatccttttctggtgatctggaccttcaggttccccagtgaggatgtgtgttcaggggtggacattccctctctcactctttgggcactaagtttttcagctgtctcacagagcatgtagcagcaagctgccccctctaacaggtctgtggattctcttggcttttctggtagtagttcttggagcaaaagttcacagtgtgattctctgtgcactgctctgtccgtccaagtgggagctgcaagttagtcctgcctcctatctgccattttgagacagcatcaacacagttatggaaacaagctttaaatgctgatgactgcttctccttgctaagctttttatgtctataggttgtctttaattagaggaaaactactagcccattatttcttcaaatatttcttcacccatattttctgttttccttctgcaattccagttgcatgtttaatccatttcacagggacacacagatatgactctttcttcttcccatgcctcctcttcatctttgtttcaatttgaataatctgtataatttttattgttttgccctccagttcagtggtcctttcttttaaggtgtcctatctgttgttatctgctgttatctgttgttaggtccatctaatgaattttcattttatctgttataatcttcaggtctagactataattcatttattttttaggatttccatttaagagaaatggaaatcctgacttccatgaaattctccatctttgcactccttttgctcatggttcctcataagttatttaacatatgtgtaacagatattttaaaattcttgcctgctaatgccaacattttgattatctgtaggattccttttattcattgttctttttctttgttatgggtcatctatttctgctaattcacatgcctcagaatttgattataggttagaactgccagacatgtaatcagtagactgaaatagcaaacgtcttccctcagaaaaggctcaccatttcctttttcagaaagctagggtgaggggtagatctcttttcaaatcaggagctgacttgggttgggactgggctgttgcttagttaatttcaatacacctattataactctccccaaaatgagatgagttattccttctagggggactttgggatttaaacttctagagattatgggaactctctctgccttactcccagtttcctgtcagtgcttaagcttcaaaagtcctcttggggagaactgataggcggagaggactgagtgacatttgggatctttcagattccaatctatcatgccagtccacatagtccttagaagttcagctaatctctccttgcctcagcagtagctctgattatagaaggcttgctcctctgtttgcctggtttctatctcaataaatgttcccatgtatttaagtgactgtttgtctttacttctttatgcagtagggttcatttctctttgcaatttattttgtttagaattctctgtgaccacatctctttgatggctttttagtttatgtgaggtcttctcaataatatggtaagagtgatgatcattacaatgtacatattaattagaagcaaaactctacttccaattatttatatggttgctttttaaaattttcttgttttcggtctatttcagtggatactccttttttttcttgcctgttgatcttgaattcttgttttcaattttaccaacacttaaaatctgctattagttcccttctggattctaacagtaataaatacatttattatttatccaaataaatttatgtctaaacctctctccaaccaagatactatacataccaatatctccttgctccacatcaagattaaacttttagaaggcttttatttctctattctttttatatagttaagtttaaagagataaaaatgcatgggaatttgtagaagtgctaagtgtgaatttatgaaacaaaatgatatagtgtaagaaaacacctaattttttcctctatgcctaacagaaaaatctaatgttttcctctgtcttgagatttctgtttcattgaattgtcatttggttacagtactctctaaatccttgtatatccaaatatgccttcctttggataagaaaccctttatcttggttgcctatatgttattccactatcagccagcttctagtgttttagatatgtcaggtgctcatgtgattttctttcctatgtaaagaacctgttcctcctctatagaagcttgtgatatttttcctttacctaggaaatcaggaatttcactagagtacggctgagtgcctttgttatcattaatcttttcccgggacttgataaaccctttgacctgcagagtcttatcattcttctgctcagggaaattttattctattatttaattttatagctcatctttaccttcacaacttttatcttcatgataatcttttcaactaatcttctatgtgaacatcctttctactctagagattttaacatttgaagtcatatagtttagtttctttcgaaagatctacaaagactaagacaagaaggctagcaaaccctggagtatatatcagaatgaagttttcctgggatctcagtgccaatatgtcaaggcaaagggttggggtgggaggactttgttctactcggtgttgagcaaggatctgtgcagggtaagcaggctttttccaaaggtgtgagtagaaaattaagttttcagagttcattgagggctttcagccagcagaagctataaatccccttggaaatgggcaatatctgtaagtttaatgtttgtagtacaataagggcctagcagatcctatgaatcataataaccctaaaaagggtctatacacctggaagaaatggtttctggaagaactggcattcagtcccagtcattgggagatggctgtaacttgcaactgatgagacttgagaagagagccttactcctgtgccccagcagaggggtatcagttgggcaggtttgattttgctacaactcagacttccatcagtatagctggggcaatagaccatgaagaggcaaagaaaataattttcttcaagagcctcagtagcctgaagaagaagaaataaactagaactggtagtgatactgatgacaatagaagaattagagagtcttttaaattaaaccaaaacaaacaaaaaacaactattaagatttcttgccaggtgcagtggctcatgtctgtaattccagcacttggggaggctgaggcagaattgtttaagcccgggagtctgagactagccctggcaacatagcgagaccctgtctctaccggaaaaaaaaagaaaaaaaaaaaagaaaaaaaaaattagctggatgtgggtgtgcatgtgtagtccagctacttgggaggatggcttgagttgagcctgggaggtcaaggcttcagtgagctatggttgcaccactgcactccagcccaggtgacagggtgagactttgtcaaatacacacaaaagtttaagttaattactaaacaacaagataaccctattttaaaggaaggaaacagtggctttcagaaagtaaattagaaggtaggtaacattcctaaggtcatataactaaaagcagcagtacctggactgacacccacacctctaagccacaaacccttcagacccatttatgtgtttgtttagcccctgtggttgggacctgatttttttcatcttcatatccacagtgcctaacccaaatgcttaaaatacagaaggtcttcaagaattgactcaaatattaactgaatgaatctattctcctatgccacattcaccagattcatatgctacaatgcagtgttaggtgtattagtcatcagaatgcctgagttaacgtactaggactgttttaaaaaacgttaatttaccctttggtaatgttcctaaacttagtgcaaaactgaaatgttttacagtcatgtgctgagtaatgatgttttagtcaatgacagatcgcatatacaatgagggtctcataagattataatactgcattttgctgtaccttttctatgtttagatacacaatttttaccattgtattacaactgcctatggcattaggtatggtcacatgctgtacaggtttgtagtgtaggaacagttggccataccatatagcttaggtgtagtaggctatactatctaggtttgtgtaagtacactctatgatatttgcataatgaaaaaaatcacctaactatgcatttcttaaaatgtatcgccactgttaagcaatgcgtgactatacttaaacatttccctaatttcccagatactaatacagtctagagaagataataaaagaaattttatgtttcttgggagacacttttagtatttattttgtagaaaatcagatcatgacattttattccattgtacctaatctgaacagctgaaagcatacattttttagttttcctaaaccctaccaacctttaactcaggactacgatcaaagaaagaagaacaaagacaaacagataggctgcaaaacaaaaacagacaggaacatgtgccaagttttgaagacagaacatatgtccagcaatcttatgtatcattaccaagtggttacaagctacttgctaagcacaaggcactgttctgggaacaggagaagctctaacctccctttcatgacatcttaagagttacttgtttcgggcaatatgatacctatgcatcctatgtcagttttggcaatccccggggatctttctatatagaacagagatagaattatggtttgattatctgtgcctatgaaaacatgagatttattacattccagtagaatacagttactgaaggcagagatcttttctgctagtttatatatacatatatatatatatatatatatatatatttttttttttttttttttttttgagatggagtcttgctctgttgcctaggctggagtgcagtggcgcaatctcggcttactgcaagctccacctccaggttcacgccattctcctgcctcagcctcccgagtagctgggactacaggtgcccgccatcacgcctggctaattttttgtatttttagtagagacggggtctcagtgtgttagccaggctggtctcgatctcctgacctcgtgatccacccgcctcagcctcccaaagtgctgggattacaggcgtgagccaccgcgctcggcccttttctgctagtttaatgtgaagaagttatctgtactgagactgcaagcctttcttaagaactggaaaagaaggtaaactatgttttgcagataatataattttatatctagtaagtccaaaagaatcaatgctaaaattaacacaatcagtaccagaactaataaactggaaagtcagcatcatataaaatttaatatacaaacgtcaatttctcttacatattcaaacaaattagaagatacaatgaaagagaatatttcacttataagggcaatataaataataatatgaataaatacaacaaaaaatgtgtaaaacagtatgaagaacaccttaaaatacttctgaaaaacacaaaagtccaggtggcccttgacttatgaaggtctgacttaacaatttttcaactttaccatactttgaaagtaacatgctttcagtggaaagcatactttgagtacccatacaactactcagtttttcactttcagtggaatattcaataaactacatgagatattcaacacttaattataaaataggctttgtcttagatgatgtggcccaactgtatgctaatgtaagtgttctgagcatgtttaaggcaggctaggctaaagtatgatgtttggtaggtttggatgcttttctgacatattatgggtttactgggctataactctattgtaagtcgaggagtatctagttggaacatcccatgttgtgtgacaagacaatgtagcatcatataaatgtgagctctccccaagacaatatataaatttaatatgattttaatttttaaaaagtttttttttccagcactagacaagttgattctgaaaatcatatagaagaacatgtaagaataccttaaaaaaatcccgaggggaaaaaaacgagcaaccactggaaataaacactactcaatattagtatatatcataaaaagcctctgtaactaaaataatgcaatattaacacgagtagccatgtagatgaacagaatagattaaaatgtttagaaaaagattcaagtacatacggtttatgaagaagaagagatgttttcatatacatggtgttgggacaatatgttggggacaagtggatggacattttgaaaaataaattgaatccatactttgcaacatttgtactgcaaagtcaaaagccaaatgacaaaatgggaaaaatatttgtagcctttattattgataaatgacaaggctccctattatgtcaaacgaaagcatacaaatatacaataaagacaactgggaatatcaatataaacttgattttgtaaaaatatattttcaagttatgttcactgaaaggatctagaaggaatgattccccaatagcaatgagtgtacttagtcccagattttagtttctaaattgcattacctactaatagtatcagagttctttggagaaatgactgattccagctctggggtagggatagtaccagatgaacttaggacattataagcacagaagtgctcaaaggctaactggttcatatcaaaggacataagagcaggaatgaatgggctctcctttgccaaattggggacaatttgagccacactcaaaaaatgttagaaaagtagtacaacaaattgaatgaaaaaaacccatagtactcatatagaaagaaagacaggaatggggggcggggcggggcgcagtggtgggggcaaagaaaacactctactgaagaataaggtgataacagcactagaaaacaccattttgtatcctcagcccactacaataattatttcaggctaggatcatcaatggacactgaaatcactaagtagggttactaagcccactaagtaaggaacacacacaaagaacaaaggaaggttgggaacaagatattcacatggccttaaagtatcattccacagattattcaacaattacaaagaaaagaaaattaatttttacaatgaagagatctggtgttcaccaccttaattaaggactaaacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagcactttgggaggccaaggtgggcagatcacgaggtcaggagttcgagaccagcctgaccaacatggtgaaaccccatctctactaaaaatacaaaaattagctgggcttggtgacgcatgcctgtaatcccagctactcgggaggctgaggcaggagaatcacctgaacccgggaggcaaaggttgcagtgagctgagatcgcatcattgcaatccagcctcggtgacagagcgagactccatctcaaaaaaaaaaaaaaaaaaaaaaaaaaaaaaaaaaaaaaaagttggtccagtttgactcaaaagtcaatgtcataacaaccaaagaaagattctagattaactgatattaatgacacgacaagcaatttaagtatgaatctggactggatgctgaataaaataagcaagcaaacaaaaaactgcttgagacttatttgacacaattacggaaatctgaatacgaactgtttattagattagaatcttggttatttttcttaggtatgataatggtactgtggttagacagtaaaatatccttactttagcaaatgtatgatgaagttttgggaaggaagaagaaaatgcaaatttaggggttttattttacatttttccaattttttatggttaaaaaaaatttcaaaataaagttggggaataataggccctgaatagacatttaattatcttacagtaggcaaactgaatcttcaacagttttgcctgaatagacgattatcttacagtaggccaccgaatctttaacagttttgaacactgtaaaatattccacataagcagagtaatctggctttgagttatttatttatttatttatttatttatttatttatgatacagggtcttgcttggttgcccaggatggagtgcagcggcataatcatggctcactgcagccttgatctcctgggctcaagtgatgcttccacctcagccacccgagtagtgggactacaggcatgtaccaccacactcagctactttttaaatttttttgtagtaacggggtctcactatgttgcccaggcttgtcttgaattcctggcctcaagcaatcttcctgccccaacctcccaaagtaccaggcgcatgaaccactgagcccagcctgagttcttattttaaaaatgtctcagcattattaaaagcaattagaaaacaaatagagcactccttctcaactctggatttatcagatcaccttcctaaacataagagaaagctaaaaaattaatgcatgaatgaataaatattatatatttatattctacatgttgactgctctattcaataaatttactatgtttattgaaaaataatgttttctgggaaaattactgtcccaaccagagatatcagttatttataattctccatgattagtatttgttcctttacaattagaaaaaaacatacttcaagggataatttattagtataatatgccctgactctggggccattctgcatgtattagaagactggctctgacaattgttagatatgtgatcttggactagttatttgcaactcacatctctgggaagaccttcttgggctatgccagtctttaataatctgtattatttattcccaaatattagtcaaaaataaaattcactgataaaatgaatacataaagttagcagatttaatagacttctaaactaatgcccaaataatttaattgtgctaaccaataatcaaataccaactatactaatttctacctaaaaccataaagagttgcctacaatttttagtatttgataaatttcctcagtaaactctaatatggattgaagtctgttcaaatcgtatcgtttgtgacatgctctatatattctatctgaggctagcaggatgtgttcctaataaagcctgccacatatttattacactggcaaagccaacaaacttcaattctgtgtgttcaatccttaaaatataatttaatatctgtctttaacattattttaacaataatgttatagattgaaagtagattaacaatagattaacatagatttaacaatatattatggactgaaaatcaaaagtataaatataacaaggataagaaaggtaaatttataatttcagtatttcctttttactgatttgttattacaatgcagagttaaaaaaatacaacaacaaaagaagcttcttgtattttcttgtttcctcctttttttccttactgtctttctgggtaagaaacatccaagttatccacctcatagtcacccctaatagttcttagtttcttttcactaaatagcctcttccagcttatctcattaactcccatgggctcaaataccacacatataccaatgactccttcatctatacttacactctaagcctatattccaaaatacactgtatagttcctagcacagggcttgactcatagtaggatatttaataaatgaggttcaaatgattgagcaagctattagatatcgtgtttcagaaatgccataatatcttgtaggcatttcaaacttaatatatctaaaatacaattcattatcttcctctcaatattcctgtatctcctattttcatttatggattgctatccactcattcacctaaattagaagcctctggcaccctcaaattctacttctctatcttcactcacattctagacctccacgttaatgatttaacatctccactctcttacttcaacccccttctcctacctcaattattaaatcaccttttaactggccttcctagctgtaatgccctaacaccttttatgattcttctcatcttacaattagttcacatactgtcttctctatgaggccttattgtcttctttaacacagaatttgttactatatcatctgcattctctagtacactttgttcattccttttacagcaaatatcaaactatgcaatcccatctacctacctatttaaaaataggtttccagtgaatactagcagtgctagggatggggctgagttctgcacttcattcctacaaggttctgtacaatctgggcctgctgctacctctctgaacttactgttttctactctcctccttgttccctccaatctagctatactgacctctttgctgttcaaaatgcataccaagtacattcctgtttcaggatcttggatggggatgctattctcccaaacaacttacagcttcctagcttccttccttcctagcttccttttttccaagctcccttccctttccttccttccttcctccctccctcccccaactccctccctccttccccttctccctccctccctccccttcaccctctccctccctccccttcccctcttcctccctccttccttccttccttcctccctccctccctctctttcttcttctttgtcgtcatctgaattttgcttaattctcagctactttgtgaagctttccttgaccactccatttaaacagcaacccaaccctactcctcaggtgcaactcccttccctgctttgtcgttataatgtttttatttaacagccctctgcatccatgggttctgcatccacgcattcaaccaaccatggattgaaactattcagaaaagaaatgcatctgtaatgaacacatagacttttttcttgtcattattccctatacaatacgggacaactatttatacagcatttacattgtattaggtattataagtaatctagagattatttaaagtatataggaggatgtacacaggcaatatccaaatactgtccattttatattggggacttgagcatccaaggaccttgctatctacaaagggtcgtaaaaccaactacccagatactgagggataaccagactacatttgcttaatgtcattctccactagaaggtaagctacacaaagatgtggagttttaccagttttgttcactgatacgttcagagcatgtataaaagtgcctgggacactgtaagtatgcactgggtacttactgaatgtataaatgctcttgcattcccagtacctgcatgtgtacaaattaaacatctttttaagtaaaataacccccccccccccaaaaaaaaagtacaaagttaaaacaagaagggatttaatggtggaaaacattttttggtccattacattggtatggtattgagaatgtgagatggtgtgaacccattttttccaggtctttccataaaagagacattttaagttctagggaaaacttttaaatttaaactttgaacataagcatgatgatttagaaaaagattttcatatccaaagcaaagagaagttatttttaaaaatatgcttattatgttattttttccctgcagtagttcagtgaacattaagcacattaatttgcctgttatatgtgcatttatatctgccttttacattagcttttaaagtgttttactttcaactcttcattaaatcttcacttcaaaatcagactaaaaagactgagataacattatgcctcataatgtcactactgaagaagggaaaaaaaaaggaaaagtggactcccacaaaaaacaagcttcactgattctaagttggccaaaacaaaacacctgttcatgccctatatttctcagacaaatttaacagcaatgagatgtaaaagacttgattccttttaaaaaaagtggcaagtatacacaataacacatatacatacaaacacccatatagacattaatatgaaatacaaacacacccacatagacattaatatgaaataaactggagtcctactaagcataaactcacttattctcagaatgccgtaagatccttgggaggcagatttgaagaaagcatactaagatcattatatgacttgtgacacatgagccttacaaaaggccagcaacgaaatccagattctgagttctaagctatcatttagagaactccaaaatagatgatactgttgtatactgcatgggcaagataaatttctaaacaaggccataaaactaagtgcactttataaggatgatacatgtaatcggacttactctcccctctgtgctgccacagtgttttatacgcatgccctgttgaatttaccaccatcatattataactatttctttgcctgctggactccccagatagactggaaagcctctgagggctttcatcttccatttctcgcagtgcttggcagagtctctgttacatagtaggctctccataaacaatgcttgatgaaatgcttcaattaacttttgaaaatattaaaaatgtttttattttttaaactgaataacagttttcattagagtacttctattaaaatgtgttatttctggttcttctcaaaaaaaggatggaaaccagttagaaatcattcttaacttttattccttatgaattacagttgaatgttttcttagagaaagttgaggaaaaaagtaaattgtctgaaataagaacaatgttccactttttacttattaaccatttataacacaaaaatctcttacattgtttaaaaaaaaatgaccagtcacgcatatagtcatttgtcactttccgtatttctcagtaactttgctctcacactggtaggcaagttgctgactaagaacaacacagtgattctttacattttcattcacttttcattcaaggaaaaggcttcttaaaaatgtgcatttaaaattctagaaaatacaaatcaacattatctctaagtctctatcattaccagaaggtctggttcctaaacctaatttccattgttagttaacatcttcaataagtgatggatattcatttccagaaaacattaccagtaaattctattatatcacagactgttcactatccagaccaaactgactaaaccacaaaatgcaaaagtatgcacttcacttctctaagggaaaccttagggctattctgagtatagttttagcagattatgacctaagggtaaatgagagcttaattagatagcctccttctgaatttccagagctttcagtagacacaaactaaaatgtttaaaaactaaaaatttcttgtcacagatttaattttttaaaaagttactctgagacataaggatttacaaaggaaataaaaaaaactgttatttttgtgatacaagtgctatttcatttttcccccagaggaggaaacatgaagagctgcttgcttggttccaggcggtgcccatcctaagcaaaattagtaaaaaaaaaaaaaaaaaaaaaaaaaaaaaaaaatatatatatatatatatatatatatatacatataaaataataataattttttaaaaattggatcacttaccacagaatcacagaatataatggctgaaatgaacactgatgtgaaatatgcgaaaacaagtatatatgattaatttggagaaaaagaccttttattttgtgaattaaaatatttttcattatcagaaatgtgtccaacattttgtatatataaatatatacactgtaatagtgaagaactaaagatggcttaaaattatgattgattgattccttccttcccccctccctttttttttttttttttttttgagacagggtcttgctctgtcacccaggctggaatgtagtggtacaatcatggttcactgcagcctcaacctcctgggttcaatcgattcccctctgcctcagccttctgagtaggtgggaccacaggcatgtgccaccactcctggataattaaaaaaacattttttttaaagagacagggtcccactgtgtggcccaggttggtcatgaactcctaggctcaagtgaatcacctgacgggattacattggtatggtatagagaatatgagatggtgtgaacccatttttcatacccaaagcaaagtgttgggattacaggtatgagtcatcttgctcagccagaatggaatactcattttcttcaaaggcatgtattaagtgtattatcagaaaaaaaaagttatagaaaaacctattttaaaatctaagtatttggaaatatattttataacaacatcattttatatgcccaattatcttaaaaattgaactgtccatttcgatttgagattacaaaattataaaatgcattttatggttgatagtaaactatattaatgtagtcatatcgtcaaactataaaaaaataaagttatgcctggtcaaaataatttagctactttataaccaaccctctcatctcacctgttgcagccatatggcattgttgtaattcttccttcaattctcacttttgagtaaactgattactgagtttcctttaccctagaggcaaagcagtgagttgcaaaacatttactactttcaccacggtataaattatgttccgataaagtagctgaaacctttcaagtcttctactttatataataaaaaccacttattgaaatgttttcaacagtatgcctgaaagttatatttagaaataatacatatgtaccacagaaatatagattttaacataagacatttactaggtttagttctaagaacatagtgctttccctttctaaaatttagtgggaagttagataaatttaaaataaaaacattcaatgattaaagtagttctgaatatagttataaagatacaatctattattcctattgcactgtaagacaaacaaattttggtatttaaaacctttcacttgtagtaaacattttcctgtcctctattttcaaatgacaagtctctgaaatgaaataataacttgctcaagtcacagcattaagcaacagaatatggatctaaatacaaatgcctctgacctccggctaagtgctaccagaatctcatgtatttatttaaataggaaaaataagacacttctagagtccctattcaagctaatcaaaattgcttattaataacatcttcaaaatcatgatgatgaaatgccaccacaaaatcttcaacattaggcaagttttattattaaaagtgttatttgcattcagttttttaaatggtaatctattctttatattgtaacatctgatttgctgggagtcagataatgaagtggattttataaacttgcactggcccatatggtacctgctggctagatgtggtttttaaaatgtaaattggacaggcatggtagctcacacctataatcccagcactttgggaagctgaggtgggcggatcacctgaggtcaggagttcaacaccagcctgcccaccatggtgaaatcccgcctctactgaaaataagaaaattagctgggcatggtggcaggtacttgtagtaccagctacttgggaggctgaggcaggagaatcacttgaacctgggggacagaggttgcagtgatccgagatcgcgccactgcactcctgcctgggcgacagagcaagacaccatcccccccacctcccaaaaaagtaaattaattaaaatgaaataaaattaaaaatttagttcctatgttacaccagcctctagctaccatgatggattgtgtacatctagagttcagaaaagaggtatgggttgaagataaatatctgaaaatcactggcatatgagttaaagtcatgggatcactaagggagtgggcatatatagggaataaaacagggtcaaattgcagtgaaaccatcttataagacatggaagaaaagaggaaaaattagcaaaggagaatgaagagtgcctaatgagataagaggcaaaacaagagaatgtggtatcccagaaaccatgtatttagaagtgatccaatgtgtcaaatgctgctgataggttaagcaagataagaacaaagaattgaccactggaattagcaatgaaaaggtcacttttgagcttgaaaagaagagattagagatttcaacaaattcatagaagacggaaaacgattagaaacatctgtctgaaaacattattggagggctgtagtagatatagaagctatctgactatgaaacctgtgaatttggaatcagcatatttgtatgggggaaaacctgactgaaaaccaggagaagtaacagaagattcatttgtacaatacgtaagctaaacaggctgtgaaatccctggaaagtgaaggatgcccagcattaacagcctgccacaaaacaaaaacaaaaacaaaacaaaacaaggaaacattgattgatttaggaaggtgtaatggcagaaatcagtgtctttaaattctttcttaacttaccccagacacataagtctgaggctttaatatattcacaacatttttaccatttttatgatgttatagcatttaccaatgggagaacactgatcacactgtagtgagtaactgtctacttctaacaaaaaactgttgactcttgaaggcagggtgtataatttttaatctgaacaactagcacaaaacatatcgtctggcctactataagcagttcagaagctgaatacaacaagtggtttctgaaggataaaggctgaattagaaatttggtgttaattcctaatctgaagttcattcctccacgtatcagtgcttctgtcaataaacaattgtaacaaaacatttttggtaaaaaaaaaaaaagcaccttttcttccattttgatgttatctactatagaaaagtgttttgtttttttttttcttttttgagacggagtctcgctcttccgcccaggctggagtgcagtggcatgatctcggctcactgcaagctccgcctcccgggttcacaccattctcctgcctcagcctcccaagtagctgggactacaggcacctgccaccgtgcccagctaattttttatatttttagtagagacggggtttcaccgtgttagccaggatggtctcgatctcctgaccttgtgatccgcctgcctcggcctcccaaagtgctgggattacaggtgtgagccaccgtgcctggcctagaaaagtgttttttcttttctttttttgttttttttgagacggagttttgctcttgtcatccaggctggagtgcaatggcgtggtctcagctcactgcaacttccgcctcccaggttcaagtgattcacctgtctaagcctcccgagtagctgggattacaggcgcccaccaccatgcctggctaatttttgtaattttagtagagacagggtttcatcatgttggccaggctggtcttgaactcctgacctcagctgattggcccacctcggcctcccaaggggatcataaggcatgagccaccccacctggccttttttcttttttctttttgagacagggtcttgctctgtctcgacctccaggctcaagtgatcctgccatttcagcctcttgagcagctgggactataggcacatgccactacacctggctaactattttgtattttctgtagacagagcttcgtcatgttgcccaagctggtctcaaactcctgagctcaagtgatcttacacctcagcctcccaaaagtgctgggattacaggcatgagacacagcaccttgttgaaaagcattttcttaagagaggaaaaactacaggttgcaaaatggaattatatgaagtatctcaagattttttgatacctctggggattatgttcttagagatggtcaaattctaagagaaacagaggctagcaaatggagttctgttgttgcttttgttctattttaatgtctgtggaataaaggattgtcccccaaccgaacccatgccctgtagattttggccagattacacagatgagagaatactttgattttaatcatcttaaaatctcaatgttatctcattacatgccaaagacggcttaagggtggtactcgtgtagaaagctaaagtttggaaagttaagtgttctagtggattactcaagtttaagatgcttgacaactttcttcttgaaattacttcatcttaatgccttttttggcatgcttctaaaaatactatatccattatttgtctctttgacatgttccttttcctataatcatcacttaacaaattttattaagttgtatcttaaaatatcttccactcttttggcaataaaacaaactgtataatttcaaactaaaaaaaaaaatcaaaaaagcctcccataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcctgctgacgtcagcgcctgcctacgccgccgttcccatggcgaccgatgcgtcccgcgctctaggcgaagaccgcggccccgtccccgcgcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggtaagggacccggaaatgcgcgggtgcccctacagagtcttgagttttccccgccctcacctccgaaaatgctcttttcgccttagaattgtagctagcgcagggaaaaactgactgggcaaaggaaaactggggaggctgtcatggaagccgcccagaataagaaaatgaatgaatgaggcaaagaaacagatttgtcactccccacgcgatcgcgcccacaaaagaaaacatggttttaaggcgtggaaaatgaagttgtactacagacaaaattttaagaaaaaattatccactgttcctttagagctatctccctgtgtgtgaaaaacaaaacaaaagttaaaacgccatccttttctacacctaatgctccctcccacttttctgatttctgccacaggcgccatcttcagctctgagtcaccagggctggaaaaatactagatgcgctactcgtggactcgtgaatacactcgtgaatacaggccatttcctgtacctacagccacccgctgtaagctgttgcttcatttgtacagtaagagtttatggaggccagcttttccattcttactgacattgccacaccttacaaactatatgtcttgtgcttccctaaatcctgtgaggaagcaacgagaaagattactaatccaatgcgtaccgaactgagctgttcaactttccgttctaaacatactctcctagatttctatcttgctgtaagccaccacaatcctcccagtgttttagtaagaacagtagagtatcctaaatgcatcttatgccaaagcatatccattctctctttttaacttcctcagatgggccctttaccagttctctgactccagtttgactcttaaattctccacactgctatcagaatgacctgactaaaaatgtaaatcggataatggcactctcctgctgaaaatttttgaaaggcaatctgtaagagaaaatgattactttgcctaggatacaagattctccatctccctgactagtttcatctctcgttagcttcttgttccaattttatgcaatattgaatcatgtgtaccatgcagttttatgcaacattgaattatgtgtaccatgaaaaacaatccatagcctttcacgccccgtccttactcatattgtcctctcttcctgaaaattcctccttttacactcctgcatcacagccaaatgttgtccatcctttgaatcttaagcaggttgactgactccttcaaacactcctactccctattagacttcggatactcattctatatattagactttggatgctcattctatagtttcatagtttactttgtattttctctatccccagcatctaccacagtgtctatgaaatagttggcatttcatgaacatttgttgaatgaataatggataacatatattgagctccttctaggaggtatgcattgtaggtgttttatgtacttttcatctgtcctcacaactgcatttaagtacctgcttttccaaagggaagttataactctgactgctcattcttagtagggtgttagtttcagaatacaatccccagactagcggatgtgtaaccctgttatcatctcttgcttctccatttacagtagcatgcagaggtgcagtggggtgggggaggtcagggaatatttcatagcagaagtgacatttaagtaaagaccaaaataatgtgtagagttgtccaggttaggaagggtttccaggtagaagaaggtggcgtatagtgttcactacaagaaagtttggtataatacaagaactggaagaaaaaaaaaaaaagttcaagttggctaactaaaaggtagagaatgagactaggggcttttggaggagacaaaacaagagagttaaacaagctatgaagagacccagacagtattggtcagtggaataccactatagaattttatggagtgaaattttcaaattttaatatcataaagataactctggctgcagggtggagaacagacaggaaggaagcaaatctagatctgggaataccatttaagatgccgttgctgtaagccatgtaagagacaaaggtggcatggtcaaggctaagaaaaatcagaatggagagaaatggaccaatttgagaaatttttaggaggtaaaaatgtcaggacttagtgattgattggatggaagagtgaatgataagaaataataaaaaacgatgaccagctgttttgccttccccttggcaagtaaagaggtggcaagcatgaaaggggagtgaggaaataaatatgttgggtctaatgggagccaggtttctcactgacagagaaggacgttacaaattgagagaggaagaattccacagtgacctttgtggtgatgttgaattggaattgaatatgtcagtgtcaactcatagttttcaatatatacataaacatatgtaaaaataaatatagaggaaagtatgtctgtatgtgtgtgcgtatctatctattatgctcttcctagctctatctgctgaaagggtttcagagtaatggtatactagaagcaatgagcacatgtgcctagatcttggtttctgaacagtattattcactaaaagtaactgggtcccttggagaaatggttgattttagaacaggagcctggaaaattcttgttgcaccagaagttaaggaagttaatacagaatgaagaaacatatcaaaaggtcacagaagccagcttgaaggagccaccactggccacatctgggtcaatctgagcaccaatataatgttaatggattatagtccgctaaataaaataggaatatttgagcccatactaaaatgaataaatgatttttttgaaaaatcaggataaagaaaagctctgccttacataaaaatgccaactaaatgtaatgaatgtagacagtgttatatgtagaaacatcattatttggcagtcatgatagtaacagttgattcagactagaatcatcagtgtatgctaaaactagagggtgagagtattaagagacatataatatttatatagtctcaaagtatctctccagcaaatacttattaattacacagagaaaaattagaaaacttgacagtgtagaaatctggcactggtgagcgaagttaccatcagcagtcatgagacaaatcagcatcgtgtatgtcctggttagaggcacttagaatacacttctgtgacattcctgccaaaaatgtgtaatccgaatcaatcgtgaggaaaaaatcagacaacccaaatgtcccaaattgagggacattctacaaaataatagacctgtactcttcaaagatcaaggtcatgaaagacaaaggaacaactaaagaacgtttttagattgaaggagaattaagatacatgacaattaagtggaatacatgattctgaattgaatccttttgctataaggatattattgggacaactaacaatttgaatggggtctctggattagatggtagtattttaacaatattaatttcctgattttgatgactatagtgacatagatatttttggttttagaaaatacatattgaagtattaaaggtgatgaggcttcatatctgcaacctattcaaatggttcaggaaaaaagtatacataaatactgtaaataaatataaacataaataatatacataaagaaaatgataaagcaaatgttaacagggaatttgggcgaaagcagaagttctttatactattcttgcaatttttctgtaagtttataattattttaaaactataaaagaagtttgaaaggtgccgaggtttctggctcaggtaactgggtggagaatggctaatcagttaacgacaaaaaatcaggaagagcaagcatggaggaaaagatgtttagttgcaatgggatgtatggagtgggatgttcagcaggcagttgagtatatactaaacatattaatgagccccattcaaactgaataaagcagatatgttgctttagctctcattagtcgagagtgcaagaccaagggcactccgctatcctaggagaggcaaacaattaagagtggtagtatggtaataattctaaaaattggctgagtatccatgaaaaaaattgtgtgtatatatatatatatacacacacatatatgtataaacatatatacacacatatatgtataaatatatatccacatatatgtatatatatacacacatatatgtatatatacacacatatatgtataaatatatatacacatatatgtgtatgtgtgtgtgtgtgtgtatatatatatgtatgtatataaattgaaccgtttaggaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaggaaaaaatactcaataccactacccaagagaatctaaattaacttttttgacaaatttcgtttcagtctgttttccatgcgtattttaattttggtcatgttgtgtgtaaaatgtttatttctgcttacttgaatgaacattatgttgcaatttcatttccatgctattacaatagtgcccccttaaccatggttttgctttctgaggtttcactcaacaagcttggtttgaaaatttttagagagaaaataagagattacatttacataataactattaatacagtatattgttataaaaactttatattgttattagttattgctgttaatctcttactgggcctaatttataaattaaactttatgagaggtgtgaaagttgattatagaaattgggtcattcttgttgtacccaactaaatcagagtgaagggcccaggggaaaaagcatttggggcatatagcatctgctccaagaattaaattttccacaagcccagctactgaaactgcctgttgtaatctgaaatcagttttatctgatagctaatgaaataacctgctgtgacactaagattagttttacccactgccatcactcgccaatcagagctcgccagctccccaaatgttacccattgtttctttgcaaaacaatgggtaacatttttcctttttataaaacctccaacctgatctttgtttttcagacatactgaagaccacccattctgtgtgtttgcctggaaatgcaattctcatttcccaaataaaatgtttgaaatgtggaaatttgactctatgttttatttgactttgagaaaggcatgcaagtatagtaaatacaggctttgctactacctgtagtttcagacatccactggggatcttggaacatatcccatgcagataagaaggagatgctgtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatacttccattcatacatatactaaatatactaaattataaagataacttcttaccatagattttgtcctgtcatcttgtttttgtcctttatcaagtattattatttctaaaaggctttttatgtcagtaacatatatctaccccattcattttaatggctttatgctatatcacttctaatccaaagtgtttttaagcaattatagtgaaagtgtcaaaaggtgatatggtggcttttaaaaaataagatacttttcttataagtctctcatattattatttattcctcagcattttatagatttttggtgctattttgaatgcatccaattcttattacattttctaaccggtgattgcacattttcctgcttttcctctttctagggctcctttactagttcatgcctatcaccttgacctcttgatattggaatgtcccagaggtatgttcctggacttctctatctacacgtactcactcagtgatttcttacagttctatagtcccactgtcatgtagactactcccaaatatatcccttctgcccattattcttccttgaacttcagactcataaatctaactgtatattacatgtctccacttagatgtccgacatattctcaaacttaacttttctaacactgaattcctcatctgcctcctcaaatccccactttctccatctcaagcaatgacaactccattcttccagttactcaagccaaacaccaaatacattggagtaactgttaaatcaagcttagcctaaaactacctccttacatattttaaattcagcctaaatgtttctttgtacatcttaaactataacaagtagaagtgtaaccagatgtagcctacacttgggccaatcaccaagttttggccaatcaaatgtcgtcaactattcaaaccatgtttaaataaggcaaacacaaagctgtaaccaatccagctggttctgtacctcacttccattttctgtgcctcactcctttttctgtccataaatcttccagcacatggctgcgctggagtctccgagcctactctgtctgggaaggctgtctgatttgcaaatcattcactgctcaattaaattcctttaaatttaattcagttaaagtttttcttttatcataacctttgacctttctccttttcttataccccatatccaacctatcagattactataggttcgaacccaaatcctatgaaacagaggatatggttataattttgagggaagattttttttttctctacctgaactttagcccctacaaacaaacttccttgtttatctttgctgctgtaatcttttaagggttccacttttatgcaaacatcttagttctcacactgagcaaggccttgaatcctatgctttgggaggccattgcattctaagactacattcctggcatcagcaagtgcccctctagtaaaaatgccctcagcccctactttccactcttgttttagttctttcttctctttggcccccgaggaattcaatgatgcaatttagtcagcatttctagctggttttcaggttttttttttttttttcagagtatctttgtgacatattgggaaaagaggaattccttctctctcaactgttaatacatgttgaaaggaattttatgagtaatagtaatggctttgtaatagtgattgttactcaaatttagcagatgacttactgaagtaattaaaccttccttataccctttctgtgggtggcatgccacgaaaactcgatcaacctgtatacatgggttaggtagaacccactgagctttccattatgtataaagctgtctgtagatttactggctgtgtataaataccattttattaggaaaatgttttggtttaggtctcagaaggtcccatgaaaaacagtaacttctgcagagactaaggggaagagttaaaaaatagtaataatttaaaaatccatttcagcatatgattaattcagttgtctaaagcaatgagcactagatggcagcatatcaatgtgtatcgttacctgtgcctgaaagacctcattttaagggtgtgtaaggtcttattgctgttttaccatgcaccagtttgctatcctgaactatttactttactgtttaatctgttggtttgaacttataatagttgatgagatgtatttgacaccaggtttgaaaatagagtttctagattaataaatatacaggatggtgccggtaccaccagtctgtctagcaaaatatgcaagaattcagagccctttcctgtcattaaaggccaccctccagagagcttatctttcatctatgataagaggtcttctggttggacaaaaagcacattttggacactcattcctgtcttgagtttcaaaccttttgtggccgctaatgtttaacttttcatcttactattcaaatggcatctctttactagattggaaaccactttcgtatctcttaccaagtgtgaaaataggggcctcccaaactctgttgtgggtagttaccaggtcttcttctctaaaggactcaggtcagatatctctgtcacagatgagaaaggaatttccttcttatcacatttgattgtataattagtatttaaaatgtaaaaaagaaaaaatgacataactttaatgtataatttaactggatggctccatttttctcttgttaactcagatcatttataattttttttcttttaaaatgtttagaataaattattaaagtacatgttaataatacaggagggggctgggcacagtggctcatgcctgtaatcccagcactttgggaggctaaagcgggcggatcacttgaggccaggagttcgagaccagcctggccaacatggtgaaaccccgtctctacaaaagtacaaaaagttagctgggcgtggtggtgtgcgtctgtaatcccagctactcgggaggctgaggtgggaggatcgcttgaacccaggaggcagaggttgcagtgagccaagattgtgccactgtactctagcctgggtgacggagcaagaccctgtctcaaaataataataataataataataataataaaaaaaaatagataaataaagggcttacaaggaaaaattccaaatccctgcttcacctattccttgccacagtactgttcctgagaccaaattggcttaaatagcttctgtttttgtttcttctgatgattacccatctcttactactatttcttgattcatcagttttaaatattgtcttaatctattgtggagagagatgggcagtgatttaactcattagcattgccttctactgtccctatccatctcttcccaataaagtcatagaaagaggcacagcagtataatagataagagcacagactcaagtcctacttgcaccacttgctggctgtataatcttaggcaagttactcaagctctctgagcctcttttttttctcatgtgtaatatggggataataatagtcaattccttggaggattattgtgaggataaatgtgtcaataaatttaaagcactaaacaagtgttactattactattactacatttaatttctctttgcatgtttaaataacatacttgcccctttgtttttgagccctgtatgtattatctcttgatacctcccatcgtaagaagatattgacaactttattcttcccttcactcccgccctcttctgcatcttaatctcaccttttattccatctctaactgcttttctattctctgggagatttttttaaacttaatcttctaaccatatattgaaaaatttactttagcaataacatttataatttctgagagttttatttctaatgtttaattttatagaatttaaagattcagtattttcttgactattgtgttagagttcagtcaaagagcaaaaatgaccacacccataatttggatagggaagataactgtgaactaagtaaaggatgtattaactactaagagagaactgtaaaatataccgaggtagtagctgcaaaaagtacctgctactcctaggattgaggaaaaattgaataaggaaggaaactggaatctccagaggcagagattcaggcctgagtgggcatggttgccgcaggaatgcccctctgctgctgtgagaaacaccggagggacccttgcatgcctgacaagaggaaaagaacaccagaacaaaaattgcctcttgatcatggcttatgatcctttggatgtgctgtggaatttggtttgcttgtccttggttgaggatttttgcatctatgttcaacagggatttgggccttgtcatttcttttcttgtaatgtccttgtttggctttgatatcatgctaatgctagccttgtgaatgagtttgcaagtgttccctcagcttcaattttttggaagagtttgacaagagttgctgttacagtaattaccagtgaagtgaaagagctttgcgctttttgttgttgttgttaggaggctcttgattaccgattcaattcccatactcattattggtctgtcagattttctgtttcttcataattcagtctaggtaggttgtatgtttctaggaatttatctctgtcttccagtttatccaatttgttggcatttaattgttcatagtagtctcttagaatcctttgtatttctgtggtgttaagttttaatatctcttctttcatttacaattttatgtatctgagtcttctcactttttccctcagtttaagtcttgtcaattttgtttatcttttcaaaagataagcaactctgagttttgttaataatttctatttcttttctagtgtctattttacttgtttctgctctaatctttattgtttcctaatttctagtaattttgggcttagtttgttctttttctagtttcttgaggtgtaaagtcagattgcttatttgagatctttcttttttctaaattattatttattattattattattattattattattatactttaagttttagggtacatgtgcacaatgtgcaggttagttacatacgtatacatgtgccatgttggtgtgctgcacccattaactcgtcatttagcattaggtgtatctcctaatgctgtccctcccccctccccccagcccacaacagtccccagagtgtgatgttccccttcctgtgtccatgtgttctcattgttcaattcccatctatgagtgagaacatgcagtgtttggttttttgtccttgagatagtttactgagaatgatgatttccaatttcatccatgatgtccctacaaaggacatgaactcatcattttttatggctgcatagtattccatggtgtatatgtgccacattttcttaatccagtctatcattgttggacatttgggttggttccaagtctttgctattgtgaatagtgccgcaataagcatacatgtgaatgtatctttatagcagcatgatttatagtcctttgggtatatacccagtaatgggatggctgggtcaaatggtatttctagttctagatccctgaggaatcgccacactgacttccacaatgattgaactagtgtacagtcccaccaacagtgtaaaagtgttcctatttctccacatcctctccagcacctgttgtttcctgactttttaatgattgccattctaagtggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatttcgtaggttgcctgttcactctgatggtagtttcttttgctgtgcagaagctctttagtttaattagatcccatttgtcaattttggcttttgtcgccattgcttttggtgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccattgattatatagggaatcctttcctcattgtttgtttttctcaggtttgtcaaagatcagatagttgtaaatatgcggcattatttcagaggactctgttctgttccattgatctatatctctgttttggtaccagtaccatgctgtttggttactgtagccttgtagtatagtttgaagtcaggtagcgtgatgcctccagctttgttcttttggcttaggattgacttggtgatgcaggctcttttttggttccatatgtactttaaagtagtttttttccaattctgtgaagaaagtcattggtagcttgatggggatggcattgaatctataaattacgttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtctgtcatagatagctcttattattttgagatacgtcccatcaatacctaatttattgagagtttttaacaatccgagtctctgataaaacagactttaaaccaacaaagatcaaaagagacaaagaaggccattacataatggtaaagggatcaattcaacaagaagagctaactctcctaaatatatatgcacccaatacagaagcacccagattcataaagcaagtcctgagtgacctgcaaagagacttagactcccacacaataatagtgggagactttaacaccccactgtcaacattagacagatcaacgagacagaaagttaacaaggattcccaggaattgaactcagctctgcaccaagcggacctaatagacatctacagaactctccaccccgaatcaacagaatatgcatttttttcagcaccacaccacacctattccaaacttgaccacatagttggaagtaaagctctcctcagcaaatgtaaaagaacagaaattataacaaactgtctctcagaccacagtgcaatcaaactagaactcaggattaagaaactcactccaaactgctcaactacatgtaaactgaacaacctgctcctgaatgactactgggtacataacgaaatgaaggcggaaataaagatgccttttgaaaccaacgagaacaaaaacacaacataccagaatctttgggacacattcaaagcagtgtgtagagggaaatttacagcacttaatgcccacaagagaaagcaggaaagatccaaaattgacaccctaacatcacaattaaaagaactagaaagcaagagcaaacacattcaaaagctagcagaaggcaagaaataactaaaatcagagcagaactgaaggaaatagcagcaaaaaaaaaaacccttcaaaaaattaatgaattcaggagctggtttttcgaaaggatcaacaaaattgatagaccgctagcaagactaataaagaaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaagtcctccacacatacactctcccaagactaaaccaggaagaagttgaatctctgaatagaccaataacaggctctgaaattgtggcaataatcaatagcttaccaaccaaaaggagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacgaccaaaaaagagaattttagaccaatatccttgaaggacattgatgcaaaaatcctcaataaaatactggcaaacgcaatccagcagcacatcgaaaagcttatccaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattctaaattattattaaagcaggctttatctctataaacttctctcctaaaactaattttgcagcatctcataagttttggtatgctgtgttttcattttcatttgtctcaagtttttaaaatttcttttttgatgtcttctttgacctattggttgttcaagggtttgttgttaacctaaatgtctactgacagatgaatggataaagaaaatgtggtctatacatacgatggaatattactcagccttaaaaaagaaggaaatcctgccatttgtgacaacatggatagacctagagggcattatgctgtgaaataagccagacacagaaagacaaatatgatctcatttatgtatggaatttaaaatagtcaaactcataaaagcaaagattagaacagtggtttccagggactaggggaagggggaagtggggaggtgatgattaaagaacataaagtttcagttatgcaaaataaataagttctgaagatctactgtgcagcgtagtgcctatagctaaaaacactgtattatatactacaaatttgctaagggggtagatcttatgttaagtgtccttagaacaaaaaaaaaaggagtggagggcagaagaaattttccaaggtgatgaatatatttatggctttgatggtggtgatggtttcacaagtatatatttattctcagactcactgagttttatacattatatatgtatagctttttatatatcaatcatacctcaataaagtagtttgaaataaaattaaaaacaccccctccaattctgacctcagtgtccaaccttgcagtttcttctcccagtgacctctattaacagagcctacatggaaccagccggcaaagacaagttccactgtcacaactagagaaaagaggatgggtttggaattgaaaggtaatagattattaactggcataactatctgtgaaaatattcaataaatagactgtttccttcaaatccttgaatcatttcaactttctcagtggactttttaatcttggtttatctttactggcctccctttaattctggagcctttaaaaagtgtccagggttccttagttacttgttaaaaataagggaatgaaaagttgattggttgtgggctgggcttgtccattgatcaactttcctttagggtgtttggatgggaaacaaacatactgactgcccggcttttgtccataacatgcagtttgtatagagaagaatcttctgcctttttgctagagtggtaaatccctgggttcccacttcttggggtaagggagttggggggcaattttaaccaacactaattttcaattaataccttcattttctactatatgcttccaattggtgttttctgagcttctctgtatttctgcaaggccaatttactcagcttccatagaaaccatttgcattaatttcttgtggctacctgtaacacattgccacaaacttagcagcctttggaacaatagaaatgtattctttcacagatctggaggccagaagtcaaaaaaatcaaggtgtcagcagcctagagtttttgacttctggcctccacacctgtgcagccctcccttcagaggctcggcagggaatatgttccttgccttgaccagcttttggcagccgttgacattcctcagctggcagctgtgtcactccaaatctccgcctttgtcttcacaggcccttctccttgtctatgtaatctgctccctgcctcactgttaataaggacagttattgttgaatttagggctgcccagaaaatccagagtgatcttctcacctcaagacccttgacttaatgatatctgcaagactctttccaagtaaggtaacattcacaggctgaggaatgaagacatggacatatctctttgattaccaccattcaactcactacaccactcttctaactgcttaatctctttaggaaatttgatgacctttcttgtttgctaatggcctgctttctgtcctttttattctttattgattttgtgtatttctctctcttgctctttctctctctctttctccatatatatggagaaacacacacacacatacacatataaagtatatataacaacaaatatatatacatacacacatatatataaaatatacataacaacaaatataaaatatgtgtgtatatatgtaaatatatataataattgtgtatgtgaatgtgtgtgtgtgtgtgtatgtatcctttataaccacttactgggttattaggaataaaataatataaatgtgtgtggttagtccacaatcttgactttcacatatatagtttatttcaaaagaatttttactaggtaatctctgaataaaatcaaattaagctaaagtctgggaaagtacagaacaaataagttaggttatgtaaaagagcttaatttaattagcagtttatgtatctctcctctctcttgctctctctctctctctctagctctcgcctcttaatatttttcaacctgttctgtcatgattccacaaatattcaagtccttcatgtttccagggtaacagtaagtattcggcagtttatctgacaccttccatttaagataggaaaaaaataatagaaagaaaatgtcattaatgtatgcaaggctgaccattatgacatttggctgtctgttatctttacaaatacgttctcttctttcccatgtttctggttgcaactttctgaccagtgataggaataggtggcatatatgctacccacttctccaacttgctcttgtccgtgattactaattggttatataattcattttcggtaagcctggatataggttcaaaattattttctatacaatattaaggaggcataacaatttattggagctggcatgtaaattgaaaattgcttgctgtttatgctccaaactttctacctcacagatctcatgactcgaatatattttaccactacagttttctcccatagttataattttgtcattgcttctgctctaaccaagcagttagagaaggcagtacaatatagtcaaaagagcactagattgggtgcaaaaaagcttgagtttttgttctatattaattacttgtgttatagtggataaattatttatccttctagatctcagttttcttgctaaggcaataaggcaattggactatggtaattcctaagatacttaacaactctaaaaacttttaatatccagcagccaactagatatttccacttaaacgttacatcattacccaaaattcaacccatcaaaaaatcttaattcaatgccctaaaaacatctttgccccttaggtttggtatttctcgtactttgcactctaaattcaaaatcttttagtcatgtttacttctcatcttttatttaccttctatagtttatctattaccaagtactataaattcttccttaaaaaggcctttggctctatccattactttatatatcagctctcactactctgactcaagaatttatgttcccaataaacttgacctttcacttcccttgttagccttatttctagatattttatctgtttttgtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgctgtgataactggctagccatatacagaagattgaaactggacccctgctttacaccatgtaaaaaactcagcccatgatgaatcaaatacttaaatgtaaaactcaaaactataaaaaccctggaagatatcctaagcaataccactctggtcagagcaacaagcaaaaatttcatgaagacaccaaaagcaattgcaacacaagcaaaaattgacaaataggatctagttaagcttaagagattctgcacagccaaaaaaaaaaaaaaaaaaaactatcagcagagtgaacagacaacctacagaatgggagaaaatatttgcaaactatgcatattacaaaggtctaatatccagcatctataaggaacttaaacaaaattacaagagaaaaacaaccctattaaaaagtgagcaaaggacatgaccagatactttgaaaaagaagacatacttgcggccaacaagcatatgaaaaaagcttgatatcaccgatcattagagaagtgcaaatgaaaaccacaatatcatctcataccagtcagaatggctattactaaaaaataaaaataaaaagatgctggcaaggttgtggaggaaagggaacacttatacacttggtgagcgtgtaaattagttcaatgattgtggaaaccagtatggcgattcctcaaaatcctaaaagcagaactaccattgtgcccagggatcccattattgaatatctacccagaggaatataaattattctgccataaagacacatgcatgcaaatgtttattgcagcactattcacaatagcaaagacatggaatcaacctaaatgcccatcagtggtagactggataaagaaaatatggtgcatacatataaacaaatattatgcagtcataaaaaagaacaagatcatgtattttgtgggaatactgaataatccttactgtcccatgaagtaggttctaattatagataagaaaactgagatacagggaaactgagcaagttgcccatgatagctagtaatggatggagacataatgtttgaactcaggcagttggattcagagcctggattcctagtcactgcacagtgtcaatgcctgacagatagatgttacgaacgttaactgttatattaattgctgtacattttatcaactagatatccattccattctctccacagccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgtaagtttctctcatatttaaaggagagttatgccatatgctctcataatcatgcatatttccttgtccacttgccaaaatcctatttctccttcaagtctccttgtaaataccatttctcctttgaaggagattcaattctcgattccccagggtagactaggtattaatacttatgctatgctctaatggcctttgaacacacatgccacaatacatttatatatacaatgaatgctggtattttatatcccttttttatgataagcaccttaaggacactgctgatgggtatctgtcttagttgttttgtgctgttgtaacagaatatctgagactggataatttataacaaacagaaatttatttctcatggttctggaggctggaaagtccaaggtcaaggtgacagcaggtttggtgtctggtaaggacctggtcttcatttccaagatggcaccttaaactctgtatccatgccagaagagcagaagagagtgaacccattctccaaagtcttttttatagtggcattaattcattcatgaaggcagagtccccatgacccaaacaccttccattaggctccacctcccaacactgttgcattagggattaggttttaatgtgagttttggagggaacaaaaacattcaaagcatagcactgtccatctttgtattttcagtatttgtcacagcactctgcacagagtaggcactaactaattactgtataccttaactgactttcattctttctataccactcagaaaacatcaaagccatagaaacacaaagcctccctcccactaggtttttattttaatcagcagttctcaaaattttaagaaatgggatttcttggaaaaattcaaaatattttggggagaaaccacaactgggtttgctaataaatgctgatatctaagtactgagctaattctaacaaaattaagatttgattaaactgacctagaccaactgtgagacttgggtgggatggcagagaataacaagagagaacagaagaaggtactcttgggctgaccactggttcaatattcctagggtgcccttgctgtcccagaataattatcatgttctgggctttgttctatgagttatagctactccttttttcccacttgtgtttctcgcatctgaatctccctcctttaagccttatttaccctgttgataaagctaaacttctgttttatctccaatctcttgtaatttatttatttatttattttagtaatctcagacctcttatagaattgagcccctgttgtgttctttctagcctcttttctgtaaaactacagaaattctcccaatcttagcttagttgccaagttcctgcctttaatggacacactaactagaaaaagaacttcaaattgcctgcattgataatagcatagtggacgtgtgtgtgtgtgtgtgtgtgtgtgtgtgtgtgtgtgtgttttctgcccagcatccctttcctctagtttggtaaaaatacgttcattttaatatgaaaaataatcccctcaccctcttccattgcatgtggtcttacaggggatgtcagtgaaagagccctacccaaggcattgacacttggcctaagcaagaacaatccattatttctctgcaaactaaatctgaaatggtcttcaacagttaagatgttagtgatggttaaccatctttagggagctgccatcacagtaaccatcactaaccatcttaactgtttaagaaatgggatttcttaaatatagaacctagcccagaacatggtaattaactgtttaagatggttagtgatggttagcgtgtgctggcagctctttaaagagactattcattagtcctgaataccagattattggggtcgtcctgtttcctgtagtattctacttaatgcttgattgtttagctttttatttagttctgtgaaagactccatacctttccaataaattattttttgtgcccttaaattagatagggttggtttacattttaaaacccaaattgacaaatgtaaattccttgttgcagtgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctacttctactgcctgatgaatctttttattttaatctttactaaggtaaaacttacatattacaagagtcaccaattctaagtgtatagttcaatgatttttagtacgtttatacattacataaccatcaccccaatccagtcttagattgcatgcccaatcttgttgtgtgtattttccatggccattgatggatcctagtatcatgtactgcacgggctataccaatatcaggcccaagatgtgtagcagtcaatcctggaggtcttgtggtgcccttaaatataatgtaaggggagagtgtcagtgtggtggattcaggggcaattactatgctattgaagaagcactgccaagggccaaatagaaaagacactgggctcaaataataaaaatcagcaaggcagacaagaccacaggaaacagggcacttggaagaaatgccatagagtccagtcagctgctgctggatagatctgactgcttttcatagatgtagcacacatctgcttgatgacgtcacctgatgccttctatgccacatgtttcaacttcatttaatacaaattttttcacaaattagaattaacattttaaataaaaggggttgaaaatattaacagataaaagatttgccttggattgaatttttttattcctcctattaccattcattttaatgtgaacccatctgtgagaaaagtggataatttatgtgaataatgtaatgatgctgtattctcctagataatattatactgtttttgaaattatctcctgcccccattccaaacttattgatgaatggcactgtataggagtatcaaaaaactaagtttgcagattcctgagactgagtatagagggctgatgttaatcataagaagatctcatattgaaacagaacaactgcggtaaatttggaagagaataacgctttttttttttggagacagagtcttgctctgtcacccaggctggagtgcagtggcacaatctcggctcactgcaacctctgcctcctgggttcaagtgattctcctgcctcagcctcctgagtagctgggattacaggcgcatgtcaccacgcctggctaattttttgtatagttagtagagacgagatttcaccatgttggtcaggttggtctcgaactcctgacctcgtgatccacccccttcagcttcccaatttatcacttctttggaggccaacaaagtgctgggattacaggcgtgagcccccacgcctggccaagaataaagcttttaatctttcccctcccctgatctctttgctttctgaaataatctcctcacaaggaggtgaaacattgagtggccagcctggccttgctgttgcttctgtatatcccagcctgtcactcttaggagcacgatgaagatctataagtatctctactttggtccagctacacctccccttgaggaatatagattggaaagggtacagaatatgtttcctcattggtaatgttaaccttttatttcttctgaataatttaatatttgatgtgaaaggctattttttgaagtatcacataatgaaacaacagccctgaacaatatagacattagaagcatttttttcttttaccttactacatgcgttaccaaggaaacaaaagaaattggaaaacaaagaaaaccaaaggagatgtagcaatattgggggttataataactttgtgaaaaagtttcttgcagaggtaagttcagttaaggcacctaaaagcatcttgacaactgataactcacactgcatggtggatacaaaatgtccaatgaaattcccaagattttttaaagcaaatggtgtctgtttctcaccaaggatgcaaatccaaactgttatccaagtcttgttcatagtgctttctaaatatctccagaatgcattgatctttattatttcttgatctctgttgcgctttctcaagccttcacgacagtgtatgtcttccctggattactgtgatgatctcctactagactccctgccctcaatcatgcctctgtaatctgtagtgtgcatggttgtcagcaactctgttcatggccaccatacttaaatttttaaatttctcatgtttcagaataaggaaccctttaacttgacatattaggaagacgcttcatgacctaattcctatgtaatctttccaacatcatctctcacggctgtcctgccttatactagatgtgtcaaatgatgcaattacttcatttgtttatctacttagcaaatattgactaagcattcaacattgtcaggcactgtttaagtgttgcaatataatggtaatactttcagtttctagaataagtcctgggccttatctcttatctctgggcctgtgcatatgtttttctctctcccgggaactctcctcttccttgaaagtataaattctgctaagtgcgctactgccttacttctggtaaaccttctctattacctaggctgaattaggtgacttgctgggtcccctcaaaatacccttctctctcatgcatttatcatgctacacctttcacttctctgtctgctccactagagtataaacttcttaaggcaatatgcctttttcatttttgtatttccaagactgtgccttgcatattatagatgttatttatgggatatcctctgaaaaatctccaagtgagtcctaagatcctagacattgcctagtaataatttttccttcatgaggtagcagatggatctaatctattttttattttattattattattattattattttgagacagagtctcgctctgttgcccaggctggagtgcagtggcacgatctccgctcactgcaagctccgcctcccgggttcacgccattctcctgcctcagcctcccaagtagttgggactacaggcgcctgctaccacacccggctaattttttgtatttttagtaaagatggggtttcaccatgttagccaggatggtctcgatctcctgacctcatgatccgcccgccttggactcccaaagtgctgggattacaagcgtgagccaccgcgcccggtatttttttattgtttttaaagtgacttatgcaaaggtggctatgcctttttataaaagattagcacaaagggagaataataacatttgcaaattatttgcttgaagcttttatttagaaatctgttacatgtccttttttgatatatatatatatatatatatatatatatatatatatatctctatagatctgtagctagattagggagaaatttgggcctaaatttgaacttttatacaccaattaaagcaagtagaatttgtaatatatttcaccacaggccacaatttctgccctggagaaggggtcagatcgtggtctccatctaggggagcagttacctgatagtcacataaactgcaggtcaggcccctctgtggtctgcccctgttcaggttggatttccaagaaaacaggctctaaggagaaggtttgaatatggagatttatttaggaaggctcttgggatccatccttggggtgggagtgaacagatggggatagagcggagtaaaaaaatacagaattgggtggagggagagaatgaataacaacgctgccataataaacacctcaactaatcctatggggaagactggggctgggatgaccccagctttgagaggcaaagggggctgtgcctttatgctcctgcacagaccagtctcccaaccctacccaactgcaacttgatgaatgagggccctttcttcaactgtggtcaattcccaagaagggaatcagatgagtactgggggagtgctatagtttgagtgtacgtgtccctccaaaattcatatgttgaaacctaatcaccaaggtgatggtattaggaggtggggactctgggaggtgattaggtcatgggggctccaggtttgtgaatggaattaatgcccttacacaagagacttcagagatctgcttcccctttcatctccttcatcccttccaccatatggggaaacagagttcatccagtcctccatgttaggatgcagcaaccaggtataatcttggaagcagagacagaccctcaccagacacagtctcctgggaccttgatcttggaccttccagcctctaaaactgtaagcaataattttctgttatttataaattacccagtgtaaagtattttgttgcagtagcaggaatggcctaagacatgtagtgagtgtttcagttctgaaactgcaagtagagatcctggttgtggactctaagttcctaaacctcctcatcacttattgggaaagtcagttttggggctcaggaccattaggaaaattcaagattcctgcctcattcaaatggagggctaaatgcagggtaggaatagcaagaaggtattttctttcaagcccatttccctcttctttcaggctgttaaaacatgttcacttgttcacctgctagtggccattggctcagggaaagtgaatcagatcccttgttcaaggggataaatttagttactcttagccaatcatggtgattctattctgcttttcagagactggtttaacaagagtcatgtgatctttctggtcaatgaaagataaggggaagccagcctggagttgcttcagaaaggctgctcttaaacagaaacatatttgaagaaacagtaactttattctgactctttatgtgtgtggcggaggaagtgatgcctagagctactacaggcacttaggccatgaggagaaccagtgtaagtcagcaagccaagatgctaaagacagcagaataagaaaatggcaagaatcttgtccttgatgctgttgagctactgaattaaccagggctgcaactccctgtattagtaaggattctccagaggaacagaaccaatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaaaaaaaaagaaaaaattccccttgtggggctgacatctagcatataaacaaatggtcaattttaatatagttttgggtttatttaagcttattacagaataaaaaaatagtgccccaaactgaccactcttgcatagccatgcccagcagccaatactacataatgtcaacctacaacacagcaccatcaagttgttactcaaatgagacctaggcttgacgggatgttaggaggtccatttctatcaatcagagtctggagttcatccatcgccctaagcctgctattgagggagccctatgtaaacatttatgtggccaccaataaatagtaagcccctcaatcccaaccctaacctcactgtgtttctagattcttgcctctgttctttgtttgcactttattctttgctggtaacggattctagccctgaactccagccaaattgtctgggcctacgaattgactagtcttgccaacctcttctctctgggggatctggatcctatcccaattttctcccctctgcagcccactggctaaggccctattacaacccagacaacctctcccattccgaacataaaactgtcatctgttggataataacatttcccacataaccagttcctggtgccatgctcccacctggcttgagatggtgactgtcaccattaatctggtttggattcaggtttggtatgtcctgttagatgctgagacttgggggagcttatagtcatatacctcagacctcccctatccccaccagtcttggcttacttctctctctcctacagatctacagctggggttctcttctggctctcctgccaaggccaatcagatcgcaatacaaaaaagtaacactttccagcattctgtagagtctgattttctaaacagttctttagattttaatgcatctcaataatagttataagtaacattttatttttttctgtggcagattaggcctcctgcaaaatagtcattttcaaaaattgtctaagattcagatgccgcacccaatgtttatgctttttgcagcaatatggtcctaattcaacatcatgcagcgtgcaaatcagtgtttcttctaacttcaacagtgataaatatttattaagcctccactatgttcatggaactataccaggtgctgctataactatttttcctttccaggaaaaataaattcaaatatggaataaaaagcccaaactcatgaaactggactgactttgcttcttaaaaattcaacatgctgcagctgcatgcttaaacctggttcaaacaggatgatgaaataaaacattattattgtgggaatataacactgtctaaataaatagccaacatgaaaactgtctctaaaacccatagcatctgtatgtgcagactgtaagtaagttatataattcctccactattctgtaacatggccaattcagaatgtcttaccattaatcttgaagacatttaaagatgttcacttttctaactcttccctttgaaaatatatttgaaccttatttgcaataaaaatctcataatattgtattactttttgatgtgtcatttctgttaaatggtgcctggaataaatcagctttgacttttcagattacatgtgttgttccagagttttagtagttacaacatacatttacattttctaatgtcctcactataatgaagataaacacaggggtaatttttctcatgtcatgtgtatataggataagattaccaggccaacagtgtcactatcagatttctttcagaaagtgtttaatgttgaattttaatcacatgcttgaacaactaggactttttgggttttatttttcaaatatgtgttagtaagaaaacagactgaaatgtggaatgtaccagataaatctctttggtgattttacatatctgtatgatcatgtttgacttagaaataccaatcttttgatcttacacttcaaatgttacatctgtgaacataaaaatctatatggctataactttccaggaagaaatcttgctcaagtaactaataaatgatccaagttttagataattctgacataattccaacatatttcctacagtattttgctttagaagactttctgacccagatatttatggctaaagtccatattttatagatcaaatgataattaccttgtagaggaaagcatttgtttttgaatagtgccaggagcaagtaagtgtaactaatattacacgatagatatttctgcagataagtgagcttaactctcgtggttaaaacttatggttaaatttccacagattagtaaaagttctcagttttattaacaattctccattttcattaaaagccctactttcctgatagttaggctgatgagaagttagttcagagggctgctcattcccatattcatcactttttattcagtaatgttattttatgaataataattttcttatttgttgaggcgtatatcatgatgtttagatgtacattactatttgtccaatgcaactaattagttaaataggaatgagttgtaatgatcagaggtaatcccagaaaatattttttcaagtttacaaacttataactttataactttacaagttataaagagaccttcataacagttaattaaatcaaagaatcctttagttggaccataagcactaacagtcggcattccgtgaatatttgttatatgtttggtattttgctaagcacttcattttttttaagtgtcatttaattttcacatgaaccctatgaaatatgtatcattattagtcttatttaaatgttgctgaagctgatgcttcaaggaaaagtatcatgcttaaggacgaacagctaccaggtggggaaccggggacctgaactgggtaatctaacttaacttctgcttcagtatcattttagttatatctttcttgtacaagtatgtctcatcttccctgttaactcttcattgataggaaagaccatctttttttaatctttatgttccattacttgccttgggcacagtagagacctataaatgtttggtgctcacatttaataaaaatgtagtaataatagcactatgatatatagcaataatttttttttttttactttttaagggttaaatagggtcaacgtgattgactcacttgtttttgcttattgtacttaaacgtctaatatgttagattaactctattattaatgatttggccacgtaaagtcaacggctattctgaaataaacaaaatggtctgtaaatcccttggtatatttttgctgccaaagagtacaaacattcattcaataaatatttattgagtagaatgaagtgaaatccaagtgcaagaaaacagcaaagaagtaacagaggtgattgagaaaatagaaaacagtagtgagattcagaatgacagcagtggcttccactttagtgtaggtagttgaaaaaagccctaccacaaagttaaacttcagctgagactagacgggtgaggaggacatgaacttggccagtttgaaggtaaagatggatgatgtggctggagtatagtgaaattgtaatttctaccaatctaaaatccaaggcaagctttgcctgagccattccagacttccctggtggatatgaattagatcattccaagtcaaatgttcatgtgttgaaatctaatactaaagatcccttaaaaaatttttagactaatttcaatgaccttccattctggtcacttaggataatgggctaaaatagaaatccctctgaaacattattctctcttactcttatggttttctgtcttctctggatcaacacgaatggtactccctccactgccccaaatattttagccgcaacttggaagcccatggcacatcctgtgtgtattaaaagagggctccattgactacctggtaatgacagatgcttggttctccttggaaaacaattcttctaggtcactcactttctccattcaagactctgacacctgggtcacaatttcatcctctgctaaatcctgttattatcttccctgacttcaaaggttcttccacctctccaactccagtgattttcacatacctttgtcaccccacaaaatactggcaactgtggatatactctgaactttgttattccctacaattgtcctgccctcttacttccagctctctcctcagaccttactctccatagatgtctctctgacaccacagacatctcttatctcatggctctgttaccccagtttatctaccacattgttcttgtttatatccctccccagcttgaaccctataacttattgatggaaccacttttttgtaccaacatccccaaatctctgaaaccttggactttcctatgcatataccttggctgttgaacagtctcagaaaaaggtcacttggtatttgctaggggccaatataatatttaacttagctggagtctaatcaatgcttgactgtcctatgctttgttcttggttagtaattcttgccacccttcccaagaacttctttagattcctgccattcccccttaagatcctttttaactttttcttggtgccttggccttttattctactgacaatattgagatgttgaagaatgaaaactttcaaacacccataccttccctcaaattttgaaccagaatcatccttgactctctcccaccaatctcagtggaagctctcttgccttcttcccaaggccaggccttccagttaggatcttgattaggatactattctgtctgttctccaattttcttatatgccttcaacttttctgcttctcttcatctgtcttttcttaaggcttatggaactcccatttaaaaaatctttgaatttgtgtgcccctttaatgttagccatgtctgtatcagctaacctttatcagctgttttcagaaagaatagtctgcacttgaccaccaccacttcttgaattccccattcattcacctattaaaatcgggcttcctcctctatcctctgcgctgacaatatctggctaaccataattgatcttactatttttaaatccatttattttatttagcatactaacccatttcttgaaaccacctctttatttcattaatgccctcttctgtcatcgaaactctctgcctattgcttccttgtcccctttttctatcttttttctttgcataattcaaaatgctggtactcttggaggtcttttttcagcccattgctcttattactctgcatatgcttcttcagataggggcagacaggatgtggttctcatttaatttcacagtatgtattatcacctataagttgacgcctcagatctgctcagcaacttaggcttccaattggaaggaccataacttagtgaaataaacatactccaattactgaaaattttctacaccaggttcccctgccactctacatacttcctcacatgatggtgccagcatgcattagaaaccaaagccagaccgcttggagtcacttgaaatgccttccctcatgctcacctcatttagtcactacatcttgctgatttcacttctaaatattgctcctctgcttttcctcctactttttagctttgctgttactcctctagttcaggcattcatcttcactcatgttgattattgttttggcctcctttgtctgcctcatcttttctggctttgcactcacagtccatcctccttcttccatcatggctgtccatttaaagggcacatcctcctgtagcagagggatgacaaaaaaaaaggagaaggagaagatgaagaagaaggacaagaagcagaagaagcagaagcagcagcagaagaagcagaagcagaagaagcagcagcagaagaaagaagaggaagaggaggaagaagaggaagaggaggaagaagaggaaaaagaagaggaagaggaggaagaggaagaggaggaggaagaggaagaggaggaggaagaggaggaagaggaagaggaggaaaagaggaagaggaagacgaggaagaagaagaggaagaagaggtagaggaagaagaagaagaagaaagaagaagaaagaagaagaaaagaagaagaaagaagaagaagaagaagaggcaaatcccataacatcactcccctgattgaatccttaatgggtataccttcacctgcccactgctaggtgctgcccactgccaggtgccccatgcttctcttcacaacagttaccacattgattgcagtcctgttgcccagatgtagccagaagcacctcagtggccaacaccttgcctcactcattctacagccttggtacctgggatactacccagcacaccataggcattcaacaaatgttaaactaaacagaatagagttaaatggaatatataaccaaagttaattccatattggagaaaaacaaacatcatggcaagtaattatttggggaacacctaatgcataccagcactgtgttggaacttcacacattttatgctgatttactagacatctgtgttacacagcagggtgaagtggtgtaaggaacatgactttttaaagagaaagatcttgggttacatcctgactgtgccacttcatagctgtgacctcgagagaactacttaacatctaatttttaatatcgcactattcaagggatagcaatgcatttctcacagggtagttgtgcagactaaaagagattaaaaggacctagaaaatgtgtggaggttaaacatgaatgccactggggcttgaacctttctcataatttgacaactgctgagaagggcaggactttttggcatgttaaggtctctgagttcaggaatgaaggggcccccatgagtcctgagtgagacttgctgaggcccagcgatattgtgtgaaacaggatttaagagtttttactttccagaaaccaagggtaacagaagtctctgtattgtaataggaggtcatacctgcttaaatacatagatagtaatttagtatttgctggtgtaaatagtacagtactattggggatacattagaaaccttaggaacatttattaaatgaaatcataatagacaaaacccttcagagtgtgccatctcttttttttgctgtgacgctgacagctcttacactatttcaaagagatttggaacaaattattggtaacaataaagcccctctaaaacttttatatggagatgtttattgcaacattatattcaatagcaaataattacaaataacttatgagatcataaagtaaatgatgagtgatgttataccaatatgataaataaaatattatttatctctacagtaaggcttatgaagactgtaggaaatagaaataaagtgcccaatgtggcatgcatctaattccataattatagctaagaaaatgtaagactatctttggataagggctaataaaaaaaaaataggtataaggtagtatgcaaatatgaatataattaggtttgggcagtaaaatctactgattttttttaattttggaagtttacataattaaaaattttaaattattttaaatgatttatgagcatcagtatcagaatattaaaaatatataaaccaagataaatgctccaagcaagagaaaagcaattactgacttaccaaattattcttctgacatcttaattataaaacctagccataatttattaccagaccctagcttcccattcttataacacagaaaatattattttatgacttacaatcaaggcacaatctcttaaataatctactttagaatcaactataagcaaaagaaaatttatctacagagctatattattagataacctggtttgtagccttgcaatgtgtattcaattgcctttatgtctatttgcctatctcctaaaatactcaaatttcggattttagcctaatacactcacaatcatgagactgattacataactggatttcaaggagaaaaaataacaaagaggaatgaattaattatctgaactttagttatatattagatttcctaaacaagaattacagacaaatttgtttattaagaaaacactgttgagaggaacatgtctttggaattatgaaaaatgatcttccagagtatatggaaagtaaagacattctgaggaaatgtccattatgaaagtccaagtgactatgcttaaaccactataaccgtagatctgattgcttgatgctataattcaattatcttctcactactttacctctcatctgatagtgaaatacagccctattttttcctctagtatttattcaaatatttttccaagtatgacacaatgactttatctcctcagtcagttgtcattcttgaggtatgtagactcatcaaccactaaaccactgtggcgaggaccctggtccatttggccaaaaattctgcccttgttcttcatcctattaaccgtaaatatattaggaatctagctagaagatgtcccaatttattattcattatagctctaacaatattaatgttaactattaagtatgaagatgatttttttttattttccattaagtcatttattgagtcacttacattatgcctgtagtttaggtaggattaatccataatttcttcccaaattcccctgtgattcgattccttgcagaggaccattaaatatatgatgagtggttggaaggttccttcttatcctatggataaaaggctctaaatgtcttaatatatttaattcttcatttaaatcacttctgatgtgtgtttattatataggtaggctctcttgaacatatagtccagtgcaactattaatgctttatttattttttatttatttattttttgagaccaggtctcactgtcgccaagccttgagtgcagtggcaggatcacagctcacggcagcctctatcccccaggatgaagtgatcccctttcttcagcctcccaagtagctgggactacaggtgtatgccaccataccgtgctaatttttgtattttagtagagacagggtttcaccttgcccaggctgatcttgaacttctgagctcaagccatctgcccgcctctgcctcctaaagtgctgcgattgcaggcatgagccaccacatctggccaacactttattgataactgtatgtatgtataagcatttctaggttgtaacaatccattggctctcagtaggcccaccagaggagtactgcacctgcaatgaaaacctgtctcagatttcaatctgcaagtgttttattatgggctgctagtaaattatcccacaagaggtcgctaaagctccggtttttttgatgtgtgatttttctgactttttctccttcctgcaaaggaattgcaaaaaattttctgtttcccggttttctatttcccagtctgttccaacttgacatgaaggtagtcaagaattagggcttagtcatgggcaaggcagcttacttatggaagtttgtagccatctagggttgctcaaatccatcacgtgaacttcagagcatttcttaccacaatttatacttgaaaaggaaatacaaccaggcaccttctgacctcaataactaaactcttttagctgtaatgtagacccctttaaaggcacattaccacttttcaggccctgggttgacattccagttttctgcacataccagaatgatagaatagacatctaaaagaggcctgcactcagtaaatatctccttagagaagatctaataaataaatgctagaggtaccctcattaatggaaaattgctgctacatctatttctttggaggatttttagactcaagcaggcagattcctgtaaagaatttggtttaaaacaaagctgatattttagaaacaatctctattttctccacagaaaacataaatattttttaacaagacatttaaaattgtgttttagagaaaaatcggcttaaaatttgagaatattttcgcccatccttagaagaattttctcttccccttagaaaaatattgcctgaatataaaaagggaatcttaccttgatttctccatctctcaaatctcagaagaaacaatgccacttttagcattcttgactagtaagattattggctatatattttcttagcaagggtcacatgttacatttttaataggttctattacatagggcagaggttataggcaaagacttctctaatgatctttccacttcccttctctacggggaatatttaacttaaaatattgtgatttaatcatatataaagagagaagtgttattgtgaatcaagcatttgaacaattttatgttttcatatgaatatagagtgttaaaattataaataacattttaattatacggatggaaaaacctggaaagatctcaaccctatgaacatgaaggatttatacaagatgattttggaatcatcccttctagtcctaaaatgtaatgactttccttaaattcttatgcttttggactataaaagcccatttctattttaatgagataactttaagtggagggcttttcttatttgaatagctgtcctgttacgatttgggagttaaatatcagataattaaaatttagttgtttacagttactgagatttttgcattatttcctcagcaataattttttatatttacaacctctatgttaatgaacacactatttcatgaagtgcttttgtaaaatgctaacataattctttcctcatgtctttttggaggtaggagactcatatactttttatcagagatgctcatgaacttgaaggcccaaatgaataataatatacagataatgaatttctacttgacttgagccatatcgcaataaagaaggaaaaatgaaacaggctagccaggagggtaggaatagaccagtcacaatgcatcaaaaggcaaatgatagtaatcagaatctcaaagaatcatacaatgagtctttttaaaataccaccaccacctactccactactctgggcttgtgttagctgacaaggcacattggttttcccgtttactcacattaagccctgggtaggcacaaccagagaacatttcaaatatgtatgggttatgaataagtgtgagtcaccgacttttagtccagctgaaactacattgtcagaagagtattaagctggcatttgcaacccacatacttaccttgtgcctgacactgtgttctgtatttaggacaaaggcttttctagtccatgcactcaggtaactcacaatacagttgaagaaaagagataagaacacagacaactacagtattgcatcagtactaaggcatgcatagcacccccacccccagctgtcttacctcttggaaatcaggttgcatcttacaattgatggtatcttgcaaatgccatgtctaggctgctgtcataagcagtcttggtttgtgtgggtgcaaacttggtcatagctgttgatcttgtcttcccttcattgaggtatgtgcactgttgataatgcatgagttgagtgaattgccatttaaaatgctttaaatgttaccttataattcagtattagaaaaaaaattgtggtatgtgcaagaagggctagaaacagtgcagtgggatgtatatttaatgtcactgaggtaaatatttaccattggaaggatgattctcatttcttattttcttgcaaacccataataaaataataattatgggttctaagaaaggaaaatacatgttgaataagttgtgtaaaatgtggtgactatgctatgtgtcaaaggattgtctatcaccttgctacaaccaagtgtggtctctggatcaggtacagtctctgcatcaacattacctgagaagttgttagatttggagcatctcaggcgccacaccagacttacaaaatcagaatcttcattttaaagtccgtaaatggttcatatgacataaaagtctgataaataattatgtcacatgccaagcaattcaatgaaagtcaggaaaaattgcctttgaagagatgaaagaaatttcaaaacaacaaggagttgatgtgaccaattcactcatgcaggactatcattaaggtgtcaaacttcaatatcagaaacttcctgctgagtttgaacagcagttgcctaacttcgtgtgacatgtattttgattgaagaaaaatgaaaacgatcagtttattgaataaaaaatgctaacaaaccatgggctctttgatatgtctcagaatcacactaaaagaaccctttcaatacatataaaataaaaattctaagtgataaggctgtgtaataattttactggcagctttttttgttccttgatgttacataaactaatagtgtgttttataattgatggtggcatagacttgatgaaaaacagtataatacagtgtgataggtgctataataggaagaagtgggagatgctatggagtaaataggtggtggtcatatctcataatcaaggtttgttaccttgagcaaaagtcagtcagatggagatgggaatgaattgaggtgggatgcagggaagttattattccaagaagagagaattacacatgcaaagccatcaaggctgtttgtcaagaagcaggtagagggattgaatcagtttttaggggatgggggagttgggatgctggattgtgttttgccttagctttggtgttacagagcaaaagcaaagggaaatagtacctccacatgtcaaaggaaaatttggtgtccaaaagctcccattcccgctaggagaactgaccttgtgtattagggttctctagagggacagaacgaataggatagatgtatatacatacaggggagtttattaaggagtattaactcacacaatcacagggtgaggtcccacaacaggctgtctgaaaactgaggcgcaagaaagccagtccaaatcccaaagctgaagaaatttgactctgatatttgagggcaggaagcatccagcacagaagaaagatggaggctgggaggctaggccagtctagtctcttcacgttcttctgtctgcttttattctagctgcactggcagctgattagattgtgcccacccagattgagggtgggtctgcctttcccagtccactgactcaaatgttaatctcctttggcaacaacctcacagacacacccgggaacaatactttgcatccctcaatccaatcaagttgacactcaatattaaccatcacaccttgtctgggatcagttttgtgtagaattaggttcacggataaagttagctttgttctcttccagtattttcttgaatgaggatggtttccacttaaggaataaagacattagttttgatggctaagaatggagttttcactcaatcctgtctgcacattgccatcaccccaagtaatgccttagccacactcacagaagtttgattaacttgctatggagaagcatgagcattggtattttttatccattgtctccatgatactactgtgcagtttatttaaaaaaatgggcttatggtcagggagggttagggcagatgaacagctggtcagcagaaaacaggaactgcagcacctataaggctacaaatgaagcaaagcatcagtcaaacacttggcctcttaggggaaaccatttatttgggcagatatggtagggaaatgcgggataaatttctgccatcatatgataagccctaggatttaccaaacaccttggatcatcttggaatcctctcattctaagataacagatctctcttctggcctcctatgggtgtttggatataaaagacagatacacaactttcacatccaggccctcagatacacatttcccagggtagccctgaggtggtgctgctgtacttgtggtcacatcttggtttgaaaacgctggtagagagagtggaacttttcccttcttttcacaaagagtatggggcttttgcaaggccaaaaatagaaaaaaaaagcctaaagttggtgcctacatgtttgtgtggagcatttaagctcaaacagggcatatatatgttgggtaagaaagtggatattcatccataatgacagtatactggtgatatctctgctatgtcttgacataaataggattcctatagttttaccttgctcagttgcaggagtgggaaaggcagctgagtggggaaactgagtcaatatatacaatgttaacagtagacttttgagccaaaggatggggtggacacattcaagaatgaaaggaatagtgggtttgcaaccgtagaggctgagagcaacattaagtaacaagtcacagacagcactgttctctcaactccctctgtgcagtgctagtgtatatgagtgggggtcccctgataatgtctactcacacaggagccagcttgagtcagtggacagctgggctgaccctacctgcatttgtacttcaaagctatgtgatactttagtgtattataggctgcacttggaggtgtgttgttttgaagacagatttgtggcacaaccagtggaatattctctgcccaagagtggcggctgaggcatctagcttattaaaaaggcctccaaactggtctccctgcctccacccttgcccctcacaactctactctcaacaaaacaatagaaatgatcacttgagaatcaaactctgtcttctctactcaaaaacccttctatggctcctctactcaggctgaaagtcaaggtcagtaccatggcctctaaggccctttgtgatttgtgtcccctcccctactcctctgacttcatctcctcttactggtccacacttctgccccagggcctttgcatttgcttgtctttctgcttaaaatactcttccctatatattttggggagctcattcttcttctcctttaaatctttgtttgagtgtcatctttgcagaaaggctttccttgaccaccgatttcgatttaaagtgacatctgactgagccagaaagaaatagattccctgaatagataaataatgagctctgaaattgaatcagtaataaatagcctaccaactaaaaaagcctcaggatctcatggattcatagtagcattctaccagatacataaagaagagctggtattattcttacagaaactattccaaaaaattgaggagggacttcttcccaactcattctatgaggccagcatcatcttgataccaaaatttggcagagacacaacaaaaaagaaaacttcaagccaatatccttgatgaacattgatggaaaaattctcaacaaagtacttgcaaaccgaatccagcagcacctgaaaaggttaatccaccatgatcaagtaggcttcatctctgggagacagtgttggttcatgaataaatgtgattcatcacataaacagaactaaagacaaaaactacatgattatctcaatagatgtggaaaagacttttgaaataattcaacatcccttcaagttaacaagtctcaaaaactaggtattggaggagcatgtttcaaaataataagagccatctatgacaaacccacaacaaacatcatagtgaacaggcaaaagctagaagcattccccttgaaaactggcacaagacaagaatgccttttctcaccactgctattcaacatagtattggaagtcctagtcagagcaatcaggcaagagaaagaaatgaagggcattcgaatagaaagagaattcaaagtatctctgtttgcagaaggtatgattctatatctagaaaactccatagtctcagcccaaaagctccttcagctgaaaaacaacttcaacaaagttgcaggatacaaaatcaatgtacaagaatcactagcattcctacacaccaacatcaaccaaactgagactcaaatcagaaaggcaatccaattcacaattgccacacatacaaaataaaatacctaggaacacagataagcagggaagtaaaagatctctacaatgagaactacaaaacactgctcaaataaatcagagaagacacaaacaaatgtaaaaacatcccatgctcatgggtaggaagaagcaatatctctaaaatggctatactgcccaaagcaatttccagattcaatgttattcctatcaaactaccaacttcatttttcacaaggctaaacaaaattatttaaaaatttatgtggaaccaaaaaaagagcccgaatagccaaggcaatcctaggcaaaaagaacaatgcaggaggcgtcatgttacccgacttcaaactattctacaaggctacagtgaccaaaacagcatggtactggtacaaaagcaggcaaatagaccaatggaacagaatggagaccccagaaataaggctgcatatctatgaccaactgatcttcgacaaaactgataaaaataagcaatggggaaaagactcccttttcaataaatggtgctgggataactggctagccatatgcagaagattgaagctggacctcttccttataccctaaaatcaattcaaaatggattaaagacttaaatgtaaaacctcaaactataaaaaccctggaagacaacctagacaatactatcctggacctaggaatgggcgaagatttcacaacaaagacaccaaaagcaattgcaacaaaagcaaaagttgacaagtgggatctaattaggtcaaagaacttctgcacagcaaaagaaactatcatcaaagtaaacagacaagctacagaatgggagaaaatatttacaaactatgcatctgagaaaggtctaatatccagcatctataaggaacttaaacacatttacaagagaaaaaacaaccctatcaaaaagtgggcaaaggacgtgaccactttcaaaaagaagacatgcatatgggcaagaagcatatgagaaaaagctcaatatcactgattattagagaaaagcaatgaaaaccacaataagataccatctcacatcagtcagaatggctattattaaaaagtcaaaaaataacagatgcgggggaggttgtggagaaaagggaatactttattacactgttggtgggagtgtaaattagttcaaccattgtggaaggcagtatggcatttcctcaaagagttaaaagcagaactaccatttgacccagtaatcccattactgggtatatacccagaggaatataaatcattctaccataaagacacatgcacgcaaatgtttattgtctcacaataccaaagacatggaataaacctaagtgcccatcagtgactgactggataaaggaaatgtggcacatacgcaccatggaatattatgcagccataaaaaagaatgagatcatgtcttttgtgggaacatggatggagctggagactgtcatcgttagcaaactaacacaggaacaggaaaccaaatactgcatattctcacttataactgggagctatatgataagaacttatgaacacacagaaggaaacaacagacactggggtctacttgaagggggagggtaggaggaggaagagaagaagaaaagataactattgggtactctgtttaatacctgggtggtgtaataatatgtacaacaaacccctatgacatatgtatatctatgtaacaaaccttcacatataccccaaaactaaaataaaaattaaaaaaattaaaaaaattaaaattcatgaaaaaaaaagtgacacccaacacttcctaacccatgtcactgctttatttttctattttcttcattcattcattcataagttccatgagagcagggctttttctcttttgttttctgctacaggaacagtaagtgcctagaacaataagtggtgattaagaactagctccttgctgaataaatgaaagaatatgtgtattatcccaaaccataatgtttcttggtgtcagtaacactgggagtgggcactgaccacgtggtccacatgcagaatatgcacagctatcctcgctggtgaccttcttgctttgtggatgtcaaagaaagtagacagctatatggactctgccacctggataactctagaggtgagtggtaggggttatgaacagcactgaggagctgggagtggctgtttgttgggtttctagcttcaggacaagttctatgagtttcctgagccctcatgatctaaaactatgaagcatgatggtgctggggtgaatactcattgtgttgcttgctcggtactcactatcctaactttgttctgaaggacccatttctccctcactctgtgtgtttcaagtaaaatatgtactgaagaaaatgccacctatttttataaatactgtgaactaagaatgatttttatatttttaagtggcttcaacaaaaatcaaaataataatatctaaatttcagtgcccataaagttttattgtaacttagccatgctaatccatttatgcatggctgcttttgctctacaatggtggaggtcagtagttgtgacagagaccatgtggcctgcaaagccataaatatttactatctggtcctctatggcaaaagtttgccagcctccacctcagactgtcgctgtggttagagtcctatgatcacagtgggtggttcagcacaagacccaggtttaaacgtctggtcttttctttgaactacttgggaagctagctctagctagctagctagctagctagctcttctgctgcctcaggtgagaaactgaggatgtcaggaagcatcaggcagcccctaaggatgaggtcgtaatcaagcttgattgaaaccattccaactctagaattttcagctgtgccaatcaatacattttctttaatcttaaattagctagcattttaagatctttgttgcttacagccaaagaaacttaactgataaagtcatttggaagaaatcctactccaggtatacagggaacagaattaatgagttcccaagatgattgccttatggtggcaacagcagttgcctggcagaagataggaaatctgtcttaatagtgccttctaggacccaaatttgtcctgctctggtagaaatcctagaagatcaggaatacaggagatgcaattagtgtttaggatcttcatttaacagcacacatctgtgtcttcccttggcataaatactgggagaatgcagtactcaggatttttatatcctcttattggaattacccacataatatatgatttattgcctatagacttctcaatttctatgtacacaatagcagcactaccatattttttaattcaaatgaaatgcatgaagatgtttgggtagaagtaatagaaaagtttagtaatgaataatgtttcattattctgtctattttctgaacatcagtcattatcaaatatagactcataatcaaataataatacatacacctacaatattttgattatgatgtttttagaaacatacatctcttttccctcctactgattaatctccttgctgtttaagcagcaaagctgctttccactcagtatctcagggaaaggatatgacatggtagacaacagaaaacaaatgaaacaactcccccacactccccaaattcaggaaacttcctggcaaaaagctcactcctttaggacaatagagagtctctgggtagagccaaattatataagagaaacatcaagggtgactgttgctttcgccttctggagaggaaaagattcccaggggtttatatagaaaaggaaggggaaaagagggaacagggaggatgtggtggcagtgcgtttggatgggtttcaaagagggagccccagttccatcaaggaccttggagcccctggaggcttctccctcgggttctgtggggccaaggagaggcgtcccctcaatcccacctggattccctgctggatcagccctagaaggaagcttcctggggctgctcccacttctgcttaagtgtggctacaccgtggagggtgggtccttaggaatgtggcaagggcagcaagattgagggggccatagtggtgcgggcatgtggagggggcacaggctttggcccgcgggcctgtgttcctatccctccctctgtcgttccctgtgaccaatgggcggagggcccattcttggcagaaacccagggaagtggcaaaattcccagacagtgttgtgagagcagtagaatgttcacaacctcctacccttgccctagcatcagggtttgacagaaaaattagattgaatgaaataaaaatatttctcacccacttgcgttcatggatggagattgatgaccttctaggtcagacacatttgtttccattagtgtggaaaatcaagagttgacttcactcctcagttcttccaagggtgacagttaaattttggctgcacaccagcagccaatggcatgcaagtgttagagcaggttatctgcatttcatgtgctggattttgcttcactgcaatgcactattgttcattttgaagaactgctttttcttcatttgattatgaagtccattcttcactgagaaagggtgaatcactgggtttcattatggagctcttgaagttcagggagagcgattttcatactaagttcattttctttaacatataaccagtgaaataatagaacaaaaatacatttatcttttataattgtttccctcctctaagacataacagtattaacataacagctatactgcataattcttcttcaaccaaagaacaagaagattaatctattctatttatttataaaatctcctgatatttctgatactggtttttcccgtcattcacctggtggaaaaagcaaggtggggaaataaacgatggtgacagctttttgctggcaatgcagaatgaggcccttgatgttattgtggcccaagggaaagtgtgagtactatattcatcagcagttctcaatcgggctattttgcacattaggggctatttggcaattttgggagatatttttgattgtcaaaactggtgaggtgggtaaggtggaaggtatgctactggcatctagtgagaagcgagatgaagctaaacatcctacaatgcagaagatagccccagcccctggcaaatagttatctggcccaaaatgtcaataataattccaaggttgagagactctgatataaagtaatcaggaaaggaggaaagatctgagtatgttaggatgattggcagggtttttgcagactgagaagagccatatggacatttgttgaaaaagggggaaagagagacacctgaagagttggataattcttttatactatgtaaggcatattttaaagggctaccgtttttagagggtacgttcttaccaactttttaaggagaggataaaattctgtgaaatcaatattatggttattaaaagcacaaaaggaccataattgtttcatgatttgtcttgctaatttcacatactatgatgttttatgtgctgagtggagataaatgtgtaaacaaaaatacgaaggtgacaaagcatggtatatttctacctggctaggttgtataggccagtgaatgtctaggggaagggtggtcctggagccaggtgagagagatcttgaatggaaagttacagagtttgaatcaattcattagaaatggaggcaggtgtattatagggttctccaggtaaacagaatcaatagggtggggagggagggaaagagagagagagagagagagagatgagagagatttagttttcaattgagggagctggcaagtcctagatttgtatgacgggcaagctggagattcaggtcagagttgatattgcaatcttaagtctggaaactcttctgcatctggaggcagaattctttctgagggcagtgagaggcaatctattccatacttctcacccagcttcttgttgtttactgatcatttttggcgttccttgtagaaacatcactcttatctctgccttcatctcatatgatgttttccctctgtggttgtctgtgtataaatttccccatttttttctatagacaccagttatattggattagggctcaccccagtgacctcatgttaactaattatagcttccacagccttatttccaaataatgtcacattatgaaatactgagggtaaggacttcaacatatgaatatgtcagaggcagacagtttcacctgtaacagggggtttgcatagagcagtgacattttctgaattgttccatgctggcaacattgcccagttttcttctcagggacatcagttataggaaaatgctatagtgaaggcaaatgggacagaatcttaaaatatttgtgaatctttgttttttcttgttctaatgataatgtaaatgtagaaaacactaacacattgtaaaacacagaaagcaaaataggtattatactgctcagttatgatactgctcataacccaatttatcagtaatagtatgtctatatttaaatatctaaaaggactattttttaaaaaatatgggtcttgctactttgcccaggctagagtgccgtttggctattcacaggtgcaatcatagttcactgcagccttgaactcctggcctcaaacaatccccccacctcagcctctcagcctcacgcgcagctggggctacaggtacgctccactgagcccagctatggaatatctatttttaataaaaatgtgaatcatagcatacgtactgttctgttattatcccttgttttcttttggacattttggacaccttttcgtgtcagaacataaagacctactaattcttttttatttactgcctagtatttcattgaatgaatgtgctatatctgtttaaccaatcccttattgagtgccatttgggttatttctaaatttttacttttacaagaaatattacagtgaatgtcattgaacatatatctttgtacagtaagtaattttttttgctgggtatttttttttttgctgggtatatttttagggatagaattgttgagccaaaaggtgtgatcattttaaactataacagacatttcaaatgcaaaaatgctgcatcaaatttttttccctcccactaaaaacatatgaattagattagtaattcctacatagaaagaattaaatagactacactgatagtgtatttaatgacactatgccagcacaataattcctgtaataatcaaagaatagttaccattgttttattaatatacacttatttgtcctccatagagctcttgttaataaatcttagcttattgctaagatttgggacttcttccagatggagtttatgattaaatgctaatcacattgttaccgaagtgttcagctttattcattatttgtttgatgtttgccataaaaattacagcccttataacccattattttggtttcaacttctcaaaataaattgaaatatatgttaaaaacttaatgtttgattactgtttaaaatgctaaaaaatatgatccaaagtatcagtgcttagaactagaaaacccaaatagctttaatcctttttgggggctttcttttcacccccgtgatgtgtgggtgtgtcaaacgtggattccttcctgttgttctgtttgctggagcaaagaatcatgtcttgataaattcacaagactagtgaatttcatctagtgtaatattgaggagtccagatcatggagaaggtgtggctaggactggtaccccccaaatactgtcatctccaatcacaattctggaaaacagtttgatataagaacatcaatgaaatggtaatttattacaccagtagagtggagctcagctatggagacacaaagcctggtgagacttggaaatcctgggcttaggccgtcagtttctggggtctgttaagaggatgcagagtgccagccacagagctgagtgtcagagaagggctatagaataggggaggaggaatagaagagccacttggtgttcttgttgtaggaggcacattaacacatcagaaatgttccaacagagaccaagctaacaaactggagaccatgaaatgcagatagtctctggagactacacatccaatgtctgaattttctaatttacttttcaaggcaaagtcattgataccatgtttttctccacaatatttttgcctgtaccaaccaagagataacatacggcacttcctaaaacaatacgattgccttctggattttcttccaaatcagtgatacctgttctccaagttttgatgatgacactgtctttagcttatcagaaggtggccatggaagatgctcagtcaacgagcaagattcatatttcttcctgaaatggttttgaaatagttgttgcgggaaatgtgaagggattgtggtcatgcagtcatgtcaccagaaataaccaaatttatccgcagctgttgtcagatacaatcaatagcaagataagcctcaatttcaaagatattaaaatgtgaaacttagaattgaatgaattattaaaatgtgaatcttagaactgaatgaaatatagtaatgtgaaaaaatttaaaatcgaatagagcttttttttaaaaacatggatcttgctgtgttgctcaggctagagtgcagtggctattcacaggtgcaattatagttcactgcagccttgagatggcttcattaattatttcctttaatcattcagcaaatattcactgaacatctttatgtacaagaccttgtggtaaaacttgccacccatttttatttgttgcttatgcctccttctaggtttcttaattagcttagctaatagtttatgaaatgtattttttattccaaagactgaactcttctatttctctattagttctgctattttctatttcattatttttgttttaattcttgtttcctttcttttatgtttttttacaactgtttaatttaaatgtcttataaacttagttgtaatcttaattatttagatatataagtatttaaatacatacatttctctctgctctagccatatcctattatttctattatgtggtatttgaactactggtatttcctagatgccttactattttgatttagagtttttcctttgatgcaaaagttgtgttagagagaaattaaacttacatgtagcagtatattttgtttttctaattttgtgattaatttctatatttgttgtagtagaggatgttatctacatgatttttactttcaggaatttattcttttttttgtggtttgacatatggtcaattttgaatatgtttaatgtgtaattgaaaagtgcgttgagtttgatttaaattaatgtatctatcttattgattaggtcatttggctcattattttttcttctacttaatctgtatcatgaagagatgacttcgtctcccatatttacttgtgtttctgtgtttctttttgtatttcttgtttctatgaatttttttattatttgtgcacaaatactcataactgttagatttttattgtgggttgtaggaattgttccaaagtacctctctttgtcatattttgcactttgtgagttgaattccacattgtctgatatcactatcttgaccctgcttcattttgtatttgccaggtaggtctttattgattctttcaactttcccatgccgctttgtttcaaacttagcttttcagtacaccatgttttactctgtgatctctttttcttttattacctttctatttattttctctaaaagatatagtctttggtttctaataggtatttttaatagcataacatagctacacagagcattatttagactgtacatgagttacttgttttaaacaacaattatcccttcttcccctgacccctcaccctccctcacaaccaccttcctatttggatgagtcctctgtacatggcatggccaatggagtccacagactgacctgtcactgccatggccacagcagttctacattcaaatggattcatgttcactgcctccacttttgccatagcttcttcttccttttattgaatggttgaagtttgtttctttaagaagtcttcacgggaccatagttcttaaattcatccatgtttgaaaatgtctactgtttgtctctttatgcctggagaacactttatgcctggggaaaactttatgcctggagaactataaaaatctctgaagtgcataatcatttccctgaagacttgacagaaagttgaaatttatctgatttttttcccttatagatgaccagattcttcctttatctttgaaattttatatattcaccagaaaagatacattaccagtttgatcgctttcatgcatttttgctgaaacatcatgtgacatttgaatttgtagattcaaatatttatttaaaaatgatttttaagttatatttttgagtacctttctgggtcttattgttttctgtttcatggaccctaaataaatgtatacttcatttcttttgtctgtcttccttccatagctttactttcctctctagtccttttaaactcttttggtttggcacagtattctcaagcttgttcttcaggtccttgaatttgttctatctgtcctcctttccgtgatatctaaatgtgacattcatttttgtgatggtcttattttccccttccatttccacctaagttctagcatttacagaggtggttctttcattaagttctcctatccaggaggacagtttaaagttttcatcagcttcatgacaatacatttgaggtatgtgttgtgggcttgtatctatttttggaagaggttgtatttcttttcttttttaagagtgtttttactttgatctcatgctttaaaaaatatctgatctttgaatgagagaaagtctttttctcagctcttagttgaactatagaatagtgctattttaccctaatctgtctctaatatgattatttacaatggttcaaatgcattttcagcagaaaaattgtttttttgaataagttccaaacttgctttccttattaaaagaagctagttggaacttgggtctgtgtgcttaatttttaagcaaaatggagcttttgctcaaaatggagcttcactgctttcattggttataaaattgaacctcatgggaagtgtaaacataaaaagcataaagaagaaagcaagaatcacccataatttttaccacttagagataatcaccatcattttgatgtatataagactgtaatttttaaagtatgtaaatttatgtgacacatgtttgtatatatagtgtgtatacacacatacacagataaatggcagatatttgcatgtgtgtgtatacacacacattcatacatatatgtgtacttagtatatatatacacatacatgtgctcatactatacatacgtaataaagtgatctaactttgctttttccctaaaggtcagagctgatgttctcaaaccttgcacagaggtcagccctagggcacaagagcaaattcatagggtgggtgccatgggaattgaaaaaagttttttctttattttctctaattctgatcctgaccctgaccccaaaccctaaccttaaccctaaccctaacccctggaattttaaaattattgagaaaaatatagtgaatgctagatgaccagttagtgggtgcagcgcaccagcatggcacatgtatacatatgtaactaacctgtgcaatgtgcacatgtaccctaaaacttaaagtataataaaacaaacaaacaaacaaacaaaaatatagtgacattgatatcttttagatactttttgagatactaaatggaagtagttcattttatagttctgtctttagattgagctatgttcctttcaatgatgttatctttgcaaatctgagttgatgaaattaaaagcaagtaaataccctgtgaaaattatctgggaacaggaaacgagggtggcagtattcattctaagtccaaggcttgagaaattgtgcagtgcccaacattaaacagatcccattaataagtaatttggttaagaatgacataaaaataatatttcaatttatgtgtattatttctttcaagcatggaaatctgtgcccggcaaaaccctcaatcaaatatatggcataaaaaagatatttttagacccctaagatcttaaaacagttacctctcttctaattggtctaaaaactttctcaggaacctgttggagaatgtactccttggaaataaggaagaaagaggatccagggaacaggagtttcaccacagaggagcaggaaagggaattcccagtatgatggcaagttgctaaattaaatgttttgcccattattttttactgggctgttggtctttttcttattgacttaaagaactctttattataggagataaacctttgttgtgttgcaaattatttcttgaaatgtttttacctcttgaatttgtctttgagtttcttttttctttgctctacagaaacttaaaatatttatttgatcaaattgattaacgtaaggataattttaactctcagatcctgtgaccctattaagttagatactataacttacagaaactaagccagctgtctgacttcttcggactttagatttgttatctgtaacatgacgagtcttctgctagctatttgtgaagtcccttccaactgtgattattgatcagtattgacttcatgtgatgggaagcttttgacaacaaatttaaattagctcctggaaaaattctagaaacaatcaacaacaggattttagataaaaccatgatattaaacatcataaaaccacaaaatatacagattgaagtggcagaaaaattcagtgactactgctgagacgacatggagaaagaacacttcctcattttgtctgaggcctggtgattcaacggctgtgtgaacggaaggtagggcatcagcaggcctggaaatatcaaactggtctctaccaagcttctcactagcaaaaaggaaagagacgggaacttgttgaaactccccctgcagcatgttttggacacaaacatttcttattgtttttttttcttttttttttctgtgagtgacaactcattcacaaaagagaaaggtgaccagagagctttgaaactcattcacaggctatagggaactttcctcactctctgagctcctccttagctcaggtaggagatggggaaggagtaggtgataaaagggagttcatattgccatgcttttgcaactctttccccttctccctaaattgctaccccatggaactttggttcatctgctgtccttatgtaatgctctgatctggatgcagctttcattagcaatatctgcaaacaggaatgagacattgcatgcatttgttctgaaatgatactaattttaaaaactatctgcaaataaatacaagtgcttctcaaccagtgtacatctttcacattgctttgtccagaacatgatcagtgaaactaaatctctagcctctgcactagactctttttaaatttttcatattttccattgctggttagtatttgttctcacatgtatatagagataaaagcatcacagctatatagcttgtgaagatttcgtttggccctgttgaaaattacacagtcagaaccatttcattagtatcaagcctctgtcaagatgtatggttagaaattgagtaagcttggaaatccgttgtatttgcacacatttgagacatccagtggggcaccagactataaaatagctggcttagcagactaaatggagtaaatgcattaggtttttgcatttagaatctaagagcatttagaatcatcatagatgagttccaaatgagaaaaataatatatatgcatttaaagcaaactaaaacgtattagagaaactctatgtgttagagtaaatattttgatagtcattgtaaagctgttttaataatgattttatatggccacatgatgccaattacttaaacatgctagatatctttcattgtaaaaataatgcaaaaatgttacaaactattcaaatataaggaagaacacagtgtgactaccttaacacaccgttgtgtacatttttctgtccatccttacaggtatttgccttgtgcagattttttacatagttgtagttgtataattcaagcacctttttgcattggctgcatttttacaactttatttataaaggtagaaatagcaacaatctttacatatttgtagtgtaacttgcttaaacattactcttatgttggatattcttttattttctattaaaatatcactactataaatatatattcatatatatacacatagaaaataattttttactcaatttagattatattaataggaagcatgatttcaaagttaaagtgtaacatattttttatggttcttgatacatatagctaaattgcttttggaaatgattgtacatatttagaatgcaattagcaatgtataaaactgccagtttcactgcaccaccatcaaaacatgatttcttcaataaactatttaatagatttaatacttaataataccttcctgggtttttttggttttcttttgttttaaattaatgccttggcagaatagggtcaatgctgctgtggaaatatagtcatggagcaagaaattcaagacttttttttttttttttttggtgtagtttagcaggaaaggtgcagagagtgtgagaaagaagccatttcatctgggtgcgtggtgaagtatagaagggttcctatttaaaaatctagggtttttctcctactttttaaaaatttggcctattctcctatttccttatgactgtgtaaagaaaaaatccccaccacctgccactttaataagaaatgtactattttgttccaaagggcacttgttttgcatgtgtcagctgaagacagaggctcatgtgaagcttaatctggacggaactgtgcagtccctaccaccatcacagctctagagccatggaaagtccaacaactaatttctgggcacagtttactgaggaggaaacttttgattctatagtctgtctttggggactccagtagatttttttgaagtatgtttaataatgtctggtacgtggaagtcctgagacttcaaacagcctcagaccatttggctcttggtcagttagagcaggtgattcaactgcttctgcaataggtagcaggcaggacacaaaaggagctagccaaggacttattgcagttgagacaggaaggagagactgcaacagcctgctaccatgaaaggtgtatgtgtgtgtgtgtgtctgcatgtgagttcattggccggggtagtaatggtgtttaggactacatttgttatctaggtaatgtaggggcaagggaaatgagatagccctgtttttgttttcagtgttttccttcaaggcctgtttttctctctgggttgagaactaggaccattttcctggttactgtttctactacttagggaagtgtagggagaacataccttcctgtgtgtgaattagagcaaaggccaagtctctatgtgtgcatgtgcctgcacatgccagtgttctgcatttgaaataggtctggtgggccattaaaagggacacgggcttgagcgtttttggtcttaaaggtaggggtgacttaagcagttatagcctttgtagaaagagtctatagaaccagacacatcgaaggtctaggagaagaaaaaatggttctcctgggagaacaacattcctgggagatagtttacctactaatgaagatatggctgatcaggcaataagaattgaaggaaacaacccttgatggtgaaattggaaaccacaaggaagagaaaatgattgaagtcatggggatggtgtacttgtcacggaaaagcatgttgaagatgggaagaaatagaaacaaacttagatgtggagacctgagtggaaggagcaagtagagcagaaactcacaaatgtaaggtcagttttacatttgtcactttagaaaatcagaattaaatttatgttttaggaattttaggataaaataaataggcattcttctatcttcttaagagtattgtgagcattatagtaattcagtttccaggtatatgcaccaaagaattgaaagcagggatttgaacagatatttgcacacccatgttcatagcagcattattcacaatagccaaaaggtggaagcaacccaagtgtccactgatagatgaatggataaacaaagtgtggtacatggcatataacccagtcttaaaagagaggaaattctgatacatgctaaaacgtggatgaaccctgaggacattatactgagtgaaataagcaagtcacagaatgataaatactgtatgattccatgtaatcataattatattccatgtaataaatactgtataattccatgcactctaagtaatcaaaattcatagagatagaaaatacaatggtggttgccaaggtccaggggaagggggaataggaaggtagtagtgtttaatagatacagagtctcaggaagattaaaaagttctagagatggaagatggtgatggctgcacagtaatatgaatgtacttaatgccactaaactgtatacttaaaaatcgttaagatggcaaattttttgttatgtgtattttaccacaatgaaaacaagtggagggctcaaaaatatatacatttcataaaattacagtaatctgacaaccacagttttcggaccactagagttcattaatagtgatttaaatttttatagcaattgaaaaaatctgagatctttcacaaacacaagatttagtttagtcctttatagttgttcctaaagttgtctattaaaattacttattaaactccataaacacacaaaatacaaatgtctgggccctgccccagacctattgaatcatactctccagggatagatgccaaacattcacatcttaacaggtgcttcagaggacccttatgcagcaaaaaaatacaagtgcccccccacacccaaattactcttccctctttagacctgggggtaggcctcttggggatcatgcagagaaaagatcttttaaattttatcctttcaacaaatgtatgagaggctagtctggggaaataatacttcttaatcaccttgataatttataaaaatgcataagcattttataaaagggaataagggaggaccagtaataaaagatgtaattattgccatctttggtgagtggaagtttagtgtcaggtatttgatttagaaaaataaagaaatgtgacagtcctaccacttcaagcattgtagaagtatatatatgtctgcgtgtgtgtgtgtgaaatatatattatatatattactattttttccattgcctttcattaaaaaaatttttattttactttaagttctgggatacatgtgcagaatgtgcaggtttattgcataggtatatgtgtgccatggtggtttgctgcacctgtcaacccgtcatctaggttttaagcctcacatgcatcaggtatttgtcctgatgctcttcctctccacctctcccatgacaggccccagtgtttgttgctcccctccctgtgtccatgtgttctcactgttcaactcccacttatgagtgagaacacgtggtgtttgggtttctgttcccgtgttagtttgctgaggatgatggcttccagctttacccatgtccctgcaaaggacatgatctcattcctttttatgactgcatagcattccatggtgtatatgtgccactttttctttatccagtctatcactgatgggtatttgggttggttccatgtctttgctattgtaaatagtgctgcaataaacatacgtgtgcatgtatctttatagtagaatgatttatattcctttgggtatatacccagtaatgggatggctgggtcaaatggtatttctggttctagatccttgaggaatcacactgacttccacaatggttgatctaattcacattcccaccaacagtgtaaaagcgttcctatttttccacagccttgccatcatctgttgtttcttgacattttaataattgccattctgactgatgtgagatggtatctcactgtggttttgatttgcatttctctaaccatcagtgatgttgacctttttttcatatgtttgttggctgcataaatgccttcttttgcgaagtgtctgttcatatcctttgcccactttttgatggggtttttttttttcttgtaaatttgtttaagttccttgtagattctggatattagacctttgtcagatgggtagattgcaaatattttctcccattctgtaggttgcctgctcactctgatgatagtttcttttgctctgcaggagctctttagtttaattagatctcatttgtcaattttagcttttgttggaattgcttttggctttgttgtgatgaaatctttacccatgtctatgtcctgaatagtattgcctaggttttcatctagggtttttatgattttggattttacatttaagtcttcaatccatcttgagttaatttttgtataatgtatgaggaaggggagtccagtttcagttttctgcatatggctagccagttttcccagcaccatttatgaaatagggaatgctttccccattgcttgtttttgtcaggtttgttgaagatcagttggctgtagatgtgtagtgctatttctgaggtctctgttctgtttcattggtctatatgtttgttttggtactagtaacatgctgttttggttactgtagccttgtagtatagtttgaagtcaggtagtgtgatgcctccagctttgttctttctgcttaggattgtcttgactatatgggctctgttttggttccatatgaaatttaaagtagttttttctaattctctgaacaatgtcaatgatagtttaacaagaatagcattgaatgtataaatcactttgggcagtatggccattttcatgatatttattcttcctatccatgaagatagattttttttccatttgtttgtgtcctctcttatttcgttgagcagtggtttgtagttctccttgaaaaggtccttcactccccttgttaggagtattcctaggaattttattctctttgtagcaattgttaacgggagttcattcatgatttggctctctccttgtctattgttggtgtatagaaatgcttgtcatttttgcacattgattttgtatcctgagactttgctgaagttgcttatcagcttaaggagttttggggctgaaatgatgaggttttctaaatatagaatcatatcatctgcaaacagagacaatttgatttcctgtcttcctatttgaatacactttatttctttctcttgcctgatttccctggccagaacttccaatactatgttgaatagcagtggtgagagagggtatccttgccttgtgccggttttcaaagggaatggttccagcttttgcccatttgatatgatattggctgtggtttgtcataaatagttcttattattttgagatatattccatcaatacctagtttattgagagtttttaacatgaagggatgttgaattttattgaaggccatttctgcgtctattgagataatcgtggagtttttgtcattagttctgtttatatgatggattaggtttattgattggtgtatttgaaccagccttgcatcccagggatgaagctgacttaatcgtggtggataagctttttgatgtgctgctggattcagtttttcattattttattgaggatttttacattgatgttcatcagggatattggcgtgaagtttctttttttgttgtgtctctgccaggttttggtatcaggatgatgccagcctcataaaatgggttagggatgagtcccttcttttcaattgttaatggtttcagtagaaatggtaccatctcctctttttacctttggtagaattcagctgtgaatctgtctgttcctgggcttttctggttggtaggctattaattactgcctcaatttcagaacttgttattggcctattaagggattcaacttcttcctggttcagtcttgggagggtgtatgtgtccaggaatttatccatttcttctagatttcctagtttatttgtgtagaggtgtttatagtattctctgatggtaatttgtatttatgtggggtcagtggtgatatcccctttatcattttttattgtgtctatttgattcttctctttcttcttctttgttagtctagctagtggtctatctattttgttaattttttcaaaaagccactcttggattcattggtttttttgaagggtttttgtttgtttgtttgtttctatctccttcagttctgctctgctcttagttatttcttgtcttctgccagcttttggatttgtttgctcttgcttctctaattctttcaattgtgatgttaggatgtcagtttgagatctttctagctttctgatatggtcatttagtgctataaatttctctcttaacccagctttagctgtgtcccagagattctggcacgttttctctttattcttattggtttcaaagaattttctgatttctgccttaatttcattatttacccacgagtcattcaggagcaggttgttcaatttccatgtagttgtgtcgttttgagtgaggttcttaacaggactgtttgagtgaggtcctctcacttttgtgatttcagtatttttgcatttgctggggagtgttttccttccaattacgcggtcaattttagaataagtgccatgtggcactgagaagaatgtatattctgttgatttggggtggagagttctgtagatatctctcaggtccacttgatgcagagctgagatcaagtcctgaatatccttgttagttttctgtcccgttgatttgtctaatattgacggtggggtgttaaagtctcccactcttattgtatgggagtctaagtctctttgtaggtctctgagaatttattttatggatctgggtgctcctgtattgggtgcatatgtatttaggatggttagctcttcctgttgcattgatcccttgaccgttatgtaatgcccttctttgtcttttttgatctttgttggtttaaagactgttttatcagagactagaattgcaacctctgcttttttttttgcttttcatttacttggtaaattttcctccatctgtttattttgagcctaggtatgtctttgcatgtgagatgggtttcttgaatacagcacactaatgggtcttgaactctttatccagtttaccagtctgagtctttcaaatgggccatttagcccatttatatttaaggttaatattgttatgtgtaaatttgatcctgttctcatgatgctagctcgttattctgcacactagttgctgtgatttcttcatagtgtcattgggctttatattttagtgtgtttttttgcaatggctggtacaagtttctcctttctgtgtttagtgcttctttcaggagctcttgcaaggcaggcctggtggtgacgaaatctctcagcatttgcttgtctgaaaagaattttatttctcctttgcttctgaaacttggtttggctggataggaaattctgagttgaaaattcttttatttaagaatgttgaatattggccctcaatctgttttggcttctagggtttctgctgagagatccgtgctagtgttatgggcttccctttgtaggtgacctggcctttctctctggctgcccttaacatattttccttcattttgactttggagaatctgatgactatgtgtcttggggttgatcttctcatggagtatcttagtggtattctgtttttcctgaaattgattgttggcctgtcttgctaggttgcagaagttctcctggataatattctgaagtgtgttttccaacttggttccattctccctgcctctttcaggtactacaatcaatcacaggttcagtctttttacatagtcccatgtttcttagagattttgtttattccttttcattcttttttctctaatcttgtctgtctgtcttatttcaacaaatggtcttcaatctctgatattctttcttccacttgattgatttggctattgatacttttgtatgtttcataaagttctcatgctgtgtttttcagctctatcaggtcatttatgttcctctctaaactggttattctagttagcagctcctgcaaccttttatcaaggttcttagcttctttctttggattaaaacatgctcctttacctcagtgaagtttgttgttagccaccttctgaagcctacttctgtcaattcatccatctcatcctccatgcagttctgcacccttgctggagaggtattgcaatcatttggaggagaagaggcgctctggcctttttaggttttcagtttttttttgttgttgattctttttttttttttttttttttaagacaaaatctctcactcagttgcccaggctagagtgcagtggcatgatcttggttcactgcaacctctgccttccaggttcaagtgattgtcctgcctctgcctcctgagtagctggaattacagacacatgctatcatgcccggctaattgttttgtatttttagtagagacggggttttgccatgttggccaggctggtctcggactcctgacctcaggtgatccacccacctcagcctaccaaagtgctgggattataggcgtgagccaccttgcctggcctcactgattctttctcatcttcatgagtttgtctagtttcagtctttgaggctgctgacccttggatgaggtttttgtgggaacattttttttggttgatgctgttgttttgctttctgtttgtttgtttttcttccaatagtcaggtccctcttctgtagggctgctgtggcttcctggggttcatttcaggccctattcatctggttcacttccatgcctggagatgtcacttgaggaggctggaggacagcaaagatgggtgcctgctccttcctctgggatctctgacctcaaagggcactgacctgattccagtaggaatgctcctgtacagggtgtctgacaacccttgttggagggtctcactcagttaggtggtatggaatgcaggacccaattaatgaagcactttggctgtcccttggtagggggctggtgtgctgccatgtgggggaaacccactcatctgggcttcctgtattcctcagaactagcaggaggaaacactaagtctgctggttcatggagactatggccacccctcctgctaggggcttaggcccagggagattacggttctgtccctgagcccctggctggagttgttggagttcctgcagtgaggccccacccagtgaggagggatgggtcagggtcagacctgaagaggcactctggctgtagtctgccacagccggtgtgttgggctgtgggggatacctcttgggaccaagccatccagcctccctggctccagcaggggaaaagcatgacctggagctatggagatggctgctgcccttcccttgccctgggggcttagtgtgttaggcagctagcagtcccagtgttggctgccatccctccctcaaggagctcaaatggcttagacagcgggaagccgcagctgtggtgctggccgccccttcccccaataactctgcaggcttaggcagattctagctgagtggctgttgaaaatctatgtggcttcatggttgggaccctagacctgggtggcatgggctcatgagtgggatcttccattgcacagttccatgggaaaagcatggtttcccaggctgagtagcatgcttgctcactgccttcttggctggtgggtgggggctcccctgacccttgtgggtctcaggtaggccgcagaaccacactggtcttcctttctcttggtgggtcatgccagccgcctagtcagtgctgatgacagaacctggatacctcggttgccagcacaggatttgcaggctgttttgtttctttttgatgcaagcctccaattgtggctgcttctagtcatccatcttgggcctgccccccagttgcctttccagacctgtgtagggcagagcctttgggtttatgtatagaaagaatgcaaatgcaaaacattaaatttcaagccagtagataatggttctcaatccttttaactggatgccccagcagatcacagaacagcaacatgagttctagaacaaatgcaaaaggtgctctggtagaggacttcctgccagaacaagttttcaatgacaaatatgacctgttttggataagacgtattctagacttttatttactctgcttttaagtattatatatatttagcccttaattttttgttcctgtcaaaccttttattttccacgaagaagtattgtcaaccaaccattctgccagccccagaacttttcacatgcaactttttctccccatggttggcaagggatcactgtaattatttcaggcatgaaaataagcatttatacacttacttttcattaccttaagaaaaactgaacaagtaactggaagcattttaataagtgtggcagggcaaggtattaataatttacaggagcaatatccctgtacacaatcccttcctcgccccattggagtagtcttatcagaaaaaagaaaaaataataagagctgattattcccatggaagattgtcctgagggcatttgtaaaggtaaaactttgaagctgcagtcttggcacctgtagttgagaagatgtctcactgaagggacctgggacagacccatctctgattctctatgggctgctatgttaccagttctcaaagatgggggaagagaattgtgctcaggctgagttctgcactcaaatgaggaacggtaagatggcaaccacaatggaataagaacctgccctcccccaccctttttctctggaccttgtcagccctaggatccttgtaaagtccctcccttgaagggagtggaagtaagtatgtaccaatgactgatattgatcagctgctttcctacctaggtgagcaagggctcagattgcagagtaatttgatatagaaaactaaattgaacaattctagcaccttgtgttatgcaggaacttattcatgttatatatgatgatggatattgcctaccattttttaataaaattgatttccacaagacctgtttttttggggggttgggtaggggggcttgatttttcctacaggaagatgagtctttccctggatcaagtgtgggagaaagaggggaagaccgtggaactggttctgagcaaaagtgtaagttacactattatggaaaagatctatgcacattttgaaactcgaaggttttccagaattattgagtttatacaaattctgtttttaaggctgaattagcagctatcagaatccattacaatttttttgttttctttttctttttctttttttctataatagaataggcttgctgttgaggaaatgtgtgaaaataccagtgggggagcagatttttctaactgattaaaatatgtggagctgctgcaatgatttcctctgtgtttcctttggctacagataataccacaaagctaactcagtgacgcacatggccagctgataacagctgacacatgtgaatcgaaagccaagtgtgtattatcagaaagtgagttaaaaacccataaaactccccactgtctgacttgaaaacattcctcttgaaattttaatgacatggtaggtaatatttttaattctgcgtgctaaaacacttccagtgaaatctgagagtaaaagcatgtccctttaatcaatatgagctagatatacaacctaagtattaatatattcctgcaatagcaggattcctgagaattgcgtaaaattggtatcattcattaggatgtacaactaaatattggacgatcttgatttgccttttaaaatttaattttaatattgtaatcaaacattgacaaagttaaaaaactccaacagtaccatagctttaaaaagaaaaccagcagtcctctgctaaaacccttcccatcacagattcctgttccctggagatactttcaattattgtagtcgttatgtttattgtttactgtaatattttaaaataatcttatactattatttcttcaattttaattcataaaaattatctaatgacttcatattactgaagatatgaattttggtctcttctactgcccacttctctgttcacactttccttttcctatccttccaatgcgacttttgatgaaatcagtttggtacatttttcttggttaaattccctgcttattatgattatttaaacataattcaccactgagccatagtgaattatgatcctatttctttcttatacagcttttcatttttcatactaattgctttttgtcaagtttagtcttctatgcagccatcattaatttattcccaaacttcccacaggacttcagatcttctctcatctctcaatatgttaaaatacacctaaaagttaaataaaaaaataagctaataggtactaggcttaatacctgtgtgacaaaataatctgcacaagaaacccctatgacacaagtttagctacataacaaatctgcacatgtacccctgaacttagaataaaagttaactaaaaaaaaaaagtccaccaaatgtgggccatgaagatgcgcagcccagatctccttacagagtctgctataggacacatggggattgccttcagttgctgctcctacagctgcttagaacatgcttcccctaggttgttctcggccaatgactgaacatggctggggtattagggcctagtcctgtcctagtaccaatgaacaacttttgtgtgggactcccctctccactggcctggctacaactttctcagaactgtgctgtggtctggggcttttctacccaatcctcccttccctctcctttcaaaaggtcatatctgcaaacagttatccctgcctaatcctggtctggccccctttatccttcacagacattccccccagtaaatttcttgcacatccaatctcatcttggcacctgcttctcaaaacggggccctgagaggagtctgagaaagcaggctctaagatggacatgtggattggcttactctttgccctgatggtggtaaggaggaccccatcctgagagtaatatgaggtcaatggaacctggtacagttggaggctcaattacttaaatctcacttgtggtgatttgggaaaacagccagagggctgatgattgctaagttatattgatgtcctacaaaggataatgaaaaactgagagtgattaacaaatagtgaaaggctaaatgtaagtgccagagggactgttggtagttcacaaataggtccttatcttccacagtagaagaacatacacagctgagaagcagacatgggattttatagttaaagtcacaaagcctcagaaacatttaaatgctcagctgaggcaggttctggaaccctgacacatgcgatagagacatctaggagaatgccttgagattttttttttttgagacggagtcttgctctgtcacccaggctgtagtgcagtggtgcgatctcggctcactgcaagctcctcctcctgggttcacgccattctcctgcctcagcctccctagtagctgggactacaggcacctgtcaccatgcttggctaattttttgtatttttagtagagatggggtttcaccatgttaaccaggatggtctcgatctcttgacctcatgatccgcctgcctcggcctcccaaagtgctgggattacaggcgtgagccaccgcgcctggccaagggtcttgacactacagatcccctgaaccctcagagcttacggagacatctcctttttccatagcaagggctactgcttcctctaattggaagatgctggagaggcctcttcccaatcaggcaagcgccgcctcaggaatgcctccattcctgagggtcaaatcccagtgcagcttcatggggaatgtgctgggcctggtaagaaaggaaagaaaccatgtactaaaggaacagcaggaactagttagcatgaactagcagaagccaggggagtatattagtgattggattttgaggaggtgatatggtttggctctgcgtccccatcaaaatctcatcttgtagctcctataatttccacatgttgttggggggatccggtgggagactattgaatcatgggggtgggtctttcccatgctgttctcatgatagtgaatgggtctcacaagatctgatggtttgaaaaacaggagtttctctgcacaagctctctttgcctgccaccatccatgtaagatgtgacttgcttcttcttgccttccaccatgattgtgaggcctttccagccacatggaactgtgagttcaagtaaacctctttcttttgtaaattgcccagtctcgggcatgtctatatcagtagcatgcaaatgaactaatacaaaaggcttgatcaaggggaccgagaaatgaaattgtataagcaaaatttattgacttgggggtactttcttgggacataggatcctggcaaggaccccaagtgatggaacaaacttgttgccagcatggacctttgaaacctggaaaaagcaatggtctgaatgaagtggaaatgccagacatcagaagaattacaaaggctaagggaatcaggcaaagagtgaagactttaaatcagatgttaatgcctaccagaaagcatacaccatggaagaggcactgaacaactaaattgacaaaataacttggtcatttggcattatccagtcttcatgattggtcactctggtactaatgggaaaggaataataacatagtggtcatcatggtggcagagatgaaagatatacatgggcccaacagtgggaactttcccacttaccaaggtcaatctacctactgctgcctctgaacatccagtttgtcattaaccaagatcaacactgagccctgatatggcattattgctctaggggaccaaataaccacttggtggcaaaccaaccaaattgggtctcttatctggtggatggaccagcagttcgtccactctgggacagatacctattctgggtatgatttcctgcccactgagattcagctaacactgttttctgggggcttaaagaatacttgactcataggcatggaatcctgtacagcatagcatcagacaggggactcacttcacagtgatgtaggtgtgggagtagggctatgacatgggattcactgatcctatcacctactgcatcatttagaagcagctgctccatagagggttgggatgactttctaaaggcacagtgagagtcctagttaggaggcaatactctgtgaggatggtgtatcattattcaggatgtagcatatgcattagactggagaacttcatattgtattgtgaccccaggaggacgaatacatggatctgggtaccaaggaggtggaaccagaaatagctccatcccagtgatctgctgggggcctttgtactttccatcttgcaactttgggctctgcatgattgaaagtctgtactagtttgggttctctagagaaacagaaccaataggatacacacacacacacacacacacacacacacacacacacacacacaccccttccattcctgagggccaaatcccagtacagcttcatggggaatgtgctgggcctggtaagatgtgtgtgtgtatgtgtatttttatatataatatatgtcctatatatttagaagtacatatatacttcttatatatttatatatactatttatttacttatatatataatcttatgttctatctatttagaagtatgtatatgtcctatatatttagaagtatatatttttatatacaatatatagtcctatatatttacactttatatatacacattatattaaatatatatacattatatggtaccttcatattaaatacataaagtatatgatatacttcctaatatataggacatatattaagaatatatgtttttatatctctctatatatttatatgtatagagacatatcctatatgtatattcttagtatatatgtactatataaaggacatatacaaatatatatggtttttttaataagttttttttattttttagttgtattttaacatattgagagatgagagaagatctgaagtcctgtgggaagtttgggaataaattaatgatggctgcatagaagactaaacctgacaaacaacaattagtatgaaaaatgaaaatatacaaatgtatatgtccttaatctatataggacatatatattaagaatatatctctgtatatctcttatctttctatctatggagggattgatttattataagaaattggcttacaaaattatggaagctgagaagtcccatgacctgtagtcagtaagctgaagacccaggtgatctggtattaacggtatagtttcagtccaagtctgaaggcctgagaaccaggagagctggtggtgcaagttccagtctgaatgccagcaaatactgatgttgcagtctaaaaataggcagagggagtgaattctccctcacactgccttgtattctacttaggccaccaacagattgggtgaggcccacccacactggggagggcaatctgctttactcagtctgctggttcaaatgttaacctcatccagaaagaccctcgcagacacacccagaataatgtttaaccatatatctgggcaccctgtggaccagtcaggctgatacataaaattaaccatcacaaagtctatgtccccaaagggagtcattcttgcaaagagacacagtaaaggtctccttgaattataagctacagctactgccagaccacttttaatttcctgtgtccaaggaccagaaattggggacaggaggcaccatcttggcaggggcagttggcaagagaaggtaagactgctttcccacaatgggagcaggaaggaattcatgtggaaccaggtggtcctctgggtaccgcgctgcccagtgtaactgtgagtgggcacatgcagcaatcctaacctgaaaagtctctgattagaaagagctcaggctcctcaagagcaaagttttgggtgaaaccaccaggtcagcctgaagactttctgaggtgacagctgaagattagtggaattctgagtaaataacgatgaaaggagaggacgagtgcccatggcatccctaaaaccacctgcagtgacgcaaccatcatgcatcccaccagctttcctcttctcagattcctttcaagaagagaggcccatgacactttggaggaactgctcctcaaatgtgcctgaaatgaatctttttttttttcccttggcttcagcatcccaagtagctgggattacaggcgtccaccaccatgcctggctaatttttgtatttttagtagagacggggtttcaccatgttggctaggctggtctcgagctcctgacctcaggtgatccacccgcctcggcctcccagagtgccgggattacagacatgagccaccgagtgcagctgagaagcgaatctttcaagaagtgtggctataatgacaacaagagagaagggagaaaccatgtcaagaaacagtttatttaatatgagggagtgtattttaaagaacgcaaagtgggagcgacttattgaagatataagagagagggaagagataagtgattgacaataaattgtccctgagaagataggaagaaataggaccttggcagaggagtggtcaggagaaaagagaaagatgctctactgtgatcagagaaaagagtcaaaggagaggtatgagcctacatttatagttttggatgcagatggtgagggcattcctatgtgatgggttctttttctatttgaagtttgaggcaactttgcttagactgaatggcacttggtagcatgagagtggtgtgaaaagagaggtgaggtgattgtgggaatagtaggtgcaattgagatatttgttcaaaaacaagtggatctttaaaatcattttttgagcactaacaatgtcaggcacactactgagctcttttccgcattatttctaatatttaaacctatcatacttactctgagaattaatgaatattgcctttaatttattggaaaagaatgttttcttacttgtccaattcattcctttacttgtttaacatatatttactgagcttcaattatatggcaagcactgttctcagcatagtaagtaagtgtatcagtaatgcaaaccaagggctgcctgatttcaaaatccagtttccttatagtatgtcaataaaaatgatccaacaatacaaaatattgactctgtgagccctctaccgggttcacctattctaatgagacagggaactactactttatacaacaaagacagattgattatttatagttgtttaaattatttcaagtatattttcaatgataagtttggaagttgaattccaatataatttctttatggtaattaagaagatgaattagtatcttattaaaatgtattttccttacatattcaaaagcaacatcttgaatatttgaaaacgcttatggtaaaattatgactaattcatgatttagtgcatcgcacttcagctgaaatttacattggcatttactttgaagaaataatttgataaccaatgtaataatttgcacaacatttaaaaaaggtttgtgagtttgaggagtggttgtggttgcatttaactcatcctttaaaaccagctttttttaattggtcagcatatttctttgttagtaactccagtcatttattgaagcacactcaaatgatatttacttgcacaaacatattagggttataatataccttttctgtttttaaatttctatttgttgcaattgtagacagataaacgttattggccccctgtgcacatggggcttttgtgggaaaagtgcaatgctataatacattaaaagccataagcttttacattaaaaagcagtgatgatgggatgagggtaagtgccatcccatggtgttattgctatagcatcagctgtggcactattttcatgaacagacttagagttgagtacctctcaaagcaatttttatgtttgaacaaatacagtgatggatcagcagagtgagttactcatcaagaacttggcaagaaggatgagttacgctgagcaaaaatgctgctgagtttaatgactctttgggaacatgtaggcacttaagtctctggggtctaaatctggttaattcacaagtgtgaaattgtcagcctacttaaaagaggcagaaattatgcaatgcttttagaaagcaattttaatgtaagaggagcactggaagccagacagggcatagtagtattatattaatgacttttgttttgtcatggtagaacagttaattgattccatgaggaagatggaacaaaagagactttctagaaatttcattctccttctaggagagaagagataatcagggaaggatttctcattttaaatctctgaattagttcttattcctgattcaggaaaggttttctctaataagtatgcactcagagtttgaagaaaaatgtgatgtgactaaagagaaaaaacaataatatgaaatgtctttattaccttaaataagtaaaattagattcaacatacccatttgttagatactgggatttttgaagggatgatttaccatgtataacatgttctcatttctcaatgtatttcacttccttggccttcaaatattgcacttgttactattcttacactttaccagtgaaattaaatcaaggcaaataagagtttttttaacatgtttttaaaactttttagagataaatgtgttccttccactcctatcgaaaatggagtaacaaggactttctaccagaagcaactagaaaaccaagatatatacgtctggtttttaaaccttgagcctaagatatcataggcctgtgattgcttcaagaaaaaaaaaaaagaaagtgcgctctaaaattgcatttttttttttttgcatagcaggtagtacagggaggatgcattcagagaccagagattctgctaaattgaagaaaaagaggaactaacccacaaaggccaaatttgttagaatttgcaagcagtctaccagtggggaaggaacagcacaaagacagagctctagaaatctgcagagaggttcccacaagtctttggatgaatactgatctctataatgcatgagaagaaactatctgagattggagtgggtggaacaccacaaatagagtgaggagaacagtttcagagctcaaactggctagaaatagttcatgttttcaccattaaagtggaaataatttgtcatacaaagagtattgggtagaatgctcagaaaactgtcacctttgttgtggggataaactggctctatgctaaaggctgctctcaacacacacaaagcttaaggacaagcatcagaatgatttaactggttccaagcaacttaactgcatgccaaagcaaagtctaatgctattttaaggaatacaacaaaactcagtaaagaacaacgtaaaaatcacaatgaatggcatccaacagaaaactaccaggcatacaaaaaaaaaaaagaatatgattctagtaagataaaaaacagaaacaaaatctacaaaatagacccagaaatgaaaaaaataataaaaccagcagataaggatgttaaaatagtgattataaatatgctcgatatgtttaataaggtaggtaacaaggagataaataacctaaatggaatttctaaagctgaaaaacacagtatctgaaagggaaaatgcaattgaatggggtcaacagctgattaaacaatgtagaagaaaagatcagtgaactttaggatgtagaaactatccaaaatgaagcctaaagaaaaaaaaatggttaagacaaatggacgtaacatcagtgacctgtgggacaatatcaaacagtctaacatgttattacatctaattggagataaagaggtgggagacataaaaatattcaacaaaaaatggccaaatatgattccaatttgattataaacagaaattttgagaagaagccagagggggaaaaaatcttatcatatacggaagaacaaagaattgtcacagatttcttgtcaggaactgtgcaaactaaaagacaaatttaaagttctgaaagaaaaaaacttgaattttgtactgttgaatatatgtttcaaacaaatgcaaaaggaagactttttacacacacacacacatacacacacacacacgctctcttgagaaaatttgtcaaaagtacacctgtacaagaaatgttaaaggaagttctttagggcagaaaattcataactgtttttttttttattcattatgcctttttataaatgttgacatttttctttattgtaatgtatttttaccatgaaatttactttacctgaaatcaatattgctatttttatttattttacctgatttttgtcttaattagctactgttttttcttcatttgtaatatttataatatatttatttaacataccttttctaaggtggaatagtttgaatgctactttttgaattattctgtgtttgtctctttttgaattgaatttaagcaacttgaatttagttataacaaatatatttagtctgtctcctgtcattttgttttatattgtctaaggcttcattttctatgccaatactttcgtattctaaattttagggactattagtttatgtatgggtatgtgtgttgctgttgcttatatggagcatattttgtttgcttttataaattgcctactgcattagaaggcatctgtaaggcttaggtccaattctattagtgatcactttcacattcaaaactatgcttgaatctttttttaaatttccctatttctgaatttcaagaatgaaaaaaaattgctacctgtaatattacatgaataatttgatgtatttcaccattcttctagaaaatatactcatttttgctatttcattatgttattaactttttaggagactatcaaattgtttgcaacgtgatgatgtcatttcatagtcccaccaactatataggaaagatgtacttgctattgtagccttaaaaatttttagcctttagaagttttatagttttagtatttatattacggtctgtaatccatcattttgagttaattttttaaaaggtgcaaggtaaagattaaacttcatttttaccgtatggatatccagttggtctagatcacttgtggaaaagactatttttaaccctgttgaattatcttgacactttgattatcttgaaaatcaattgacaatatatgtgtgggtctattctgaattctcagtttggttccatggatctatgtatgtattcttatgttgataccatattctcctgattactgtatctttatagtaagtcttgagattaacaagtataaatcttccacttttccctcagctatgctgaatcttttgcatttctacataagttttagaatcagcttgaaaatttatgtcaaaaaagcctgtgagaatattgattaggattgcattgaatctacagaccaatttggatataattgaccttttgacaatttcagttttctaattcataaacatgtatgccttatctttttgtgtatatcatttaatttttctcaaggatatttgtataggtgttgcacaaaatttgttaaatttcttccctgtctcaaagtagaaaatagaaaacaatcacagagatgccattataaaatatatagatatagcaatcctctaaaattcccatttaactctgtagtttgaccggaatgaaagacggctatcttggagaatgatgttagattaatcaagtagtcactctaataatagcaactgttccaactaccatctccatattgaaatcctacaaatgtttcctctttaaaaaaaaaattcaaaacagaagaaccagcagcatgtctttcactaactgattcagttagctcctggggcagtgatcatctccctattttataggacatcatactcatccgttacattgaagataccatatagattcttggatagaataagaaagagagtgctaggtgccttagagtacatgtactgatgaaaatacaggagcctgacacttaattaaattttttggaatttaggagccttggtcaagaaagatagatatctttattagagtaactaatttttttttaaagagatgaagtctcactttatcaccaaggctgaagtgtagtgggcacaatcatagctcactgcagcctagaactcctgggctcaagtgattctgccacctcagcctcctgagtagctcggactacagacacatgccaccatgctcagctaattaaaattttttattttttgttttttatttatttttatttttatttatttttattttttatttttttttagagattggatttcaactatgttgctcaggctggtctcaaacttctggccccaatagatcctcccacttaggcctcccaaagtgttgggattacaggtgtgagctaccatgctctacagcaatgatttgctgaaccttgtccatccttcaatgtttagggtatcttttagattttgtaggcaacttatcccatgtataggtgtgtgctgcctaatttattaactgaatgacctaaaaagcttccccattaaggcccagaacaagggagggctttcctgatggcccaggctgcagtgtaaacagctaaactgtttggctcccatgttgcttaaagtgtctatggaagatacgaatgctgtggcaagtcctataagaggattgcagaagagactggtatctttgatttgagatgcagctggaatggaaatttgtctcacttcactttctgcctcatgtttcctccatcaccaaggaagctggtaataacttggttggtctgaacccatgcacagctcagaagtgtgagtgagttaatacccccaaggaaaacttttgactaattgggggaagaaagcagatagataaatgcttctcctgtttccctccttctgatagaaaattcagggaggtatctggaaacttctcaggagccctcaacagaacagtgcattaatatactacagccaaataccactaagaacacatctgtggcagaacaagttcggctcaaggttcattgcaacaagggagaactcccctcatagggatctttgggacatttctgtaagatggtgttaaaaggacgtataggatttttagctatgccaggtattttgaggagagttcaagaatgcagggctttgttatggattagatgctgtcaggaagtgaggataattctgactgggtgtcttaaatctttacaaggtgagaagactaaagtgagggtaaatctaattgataaagaatcatattagcaaggttagggagacgcttggtcatttgtatggtttggataatgttgtttttaatctgtgttcagatgtgattacgaagtggtatttttgctctaattcattacagttgtggtgtggccttgttgatgttgatgttctaggaaaattgttcacatccaacaggagaatgttgagacctagctgtgaatgccaggccagctcttagcaaaaccaaagtctagctggtagttccaggctattcttatcagttaagagctatttttctctctctcaagaaccactggttttctggaaggaatagcttcaagaataccctcttataatggcttttcatccttcctgttgcattctttctggcctctcactctgtctcagtctataccttcagccttctgtaggcatggtaactcaagttgagatactctttcaggaacacaaacaatattctaaatagtattccccttttgaaaaacagctgcccatcatgaactgtgctatatgatccatctggccataaggtcgggacgtgctaactatgctccatcattaagtggacgtagatattctcaacagggctcaattgttcctgaaggcaaaagtacctttcctgaataggacattcacatgtccagtgtgccttcactttattacccttcagtttgctcctgtggcctgtggacattcccaatgactagttggctgaggaggtatggctgtgagtctgctttacagatggctctgcatcatatggcatcatctgctataactggccaaaataattatgaaaaagttcagctccattcaggattggtttagaaaggacattcctgaggaggcagaatttgaaacagaaaaactcattttcccaattgtatcttgagctaaggatataaggatgggacaaggatggggaaaagttcagagctacttccttggcagcagttttctgtggcagccatgtcagaggacagtatcatgttgacatcagcagtggcatcaatcagtctcatcctgggttatggtgatggaggaccaggtacctacatgctccacatctttcccgatgccttggacttacctaaacctctgagatgaagctaaaatcctggaaaaaaaggaagtatgtaggaaaaccttgatttcactgaggaaaaaattagaataaaccacattcaccatatattgactaatattatgtttttaccaccagagaggcttgagacaaaaaataagttcagtgatcaagaaaacaaagaaaatatccactctcaaatttgtagcctgataattcagacctgtagttagaagtattgacagtggctttctagatagagacactaagagagagactaggaaacttaggttacttaagttttcttatttgtactatttttcatacatgtaacaaaattttttacaacaaatatgtattacctctataatcagaaaactataagcattgctttagaggaatatcatcaaggcaaaaacactactgaaagtcaatgatgagtatctgtgactagtattactatggttattattattacatttaacctaatagaaatggtactatacatttactattataaaccttatcctaataggagttatagttgattaaaacacttaaatttatcttgttgatattttcttagctaataatattatactataaaattaatacttctcggtcttttttgcaaactcttaaaatatgaaagacaaaattcttacctcttggtcatgtgagtcatcaatgactgtggaagctactcatgagctcatgcttatttataatcttgaatatgtgctcacacagattatataacattaagcaagaagcaattcactggcaatgcctaatattggggcagatagacacttatatgagttacacagaaaatattattactcacttttgtggacagtgggggcagagaggatttgttttcagctctaacttcagtcaggaaatgtctctactgttaacaagaaaagctctagacttactaaagttaacagcatttatttgagcaaagattgattcatgtattggtcagcactcagaaccagaagacgttcagagagctctgctctacaatgtgggcagtgagtattcatagacagaagaccatggaagcacagaaataccttaattggttacagctaggcttttgccttgtttggacatggtatgaataactggctgcttgtcatttgctgaagctctgctgcttgtgattggttgagatccggctattttaactcctaaattagattgccctacaggttgcagttctttaggtaggaacttcaagtatacagacagcctcaggctaatggccttctgcttatttaatgtagcagtaccaaaagaagtttcattctaccatatcccctttccattactgcagtgtatggaaagccacatttatcccacagagagaatagggctggaacagagggatctgaccacagtgagagggcagatcgcagagactgaataggagtacggtgctgagtgtgtagacaggattcagaaccttccacagcaatcagctgatacagactcaccgcctaatgattcagaaaatgagggatcaaagactagaatggagagagaaaaaatgaagtgtggcaagagcaacaaggggtagtgggatgcacagaaaggatccaaaggacatcagcactaatccctcagttgacaataatggctatctggaagccacctacccctgagaaattgtgaagtacatgtgtagatctcatgacacaaaagaatacttttagtatattgctgctataatcaatatgattaaaaggttaactacaaatttggagcatattggtcacaaaacagctgacatttctttctggatatgtaccaggtaatgctgagcagtttatatgccttgggtacatttaatttttccaacaacactatgaggtaggtactgttttcctcattgagaaaagtgcagaatgaccaagtggcttgcttaaggtccacagcaaatggttggcagggccagattcaggctgagatatctgacttcagagtctgagatgttaattactgcatagacttcttttccaaactgacggatctctgtgaggagcatcatcacatctctgttaggagcaactgttaatttattaaaacctactgtaggctgggtgcagtggctcacacctgtaatcccaacactttgggaggtcaagttgggtggatgatgaggtcaggagtttgagaccagcctggccaacatggcgaaaccccatctctactaaaaatacaaaaaattagctgggcgtggtggtgtgcacctgtaatcccagctacttgggaggctgaggcaggagaatagtttgaacctagggggtggaggttgcagtgagccgagtttgcaccactgcactccagcctgggtgacagagcgtgacactgtctcaaaaaaaaaaaaaaaaaaaacaccaaaaaaaccaccactgtatattccttagagtttagatagtatgactgagtggagaaaattttaagagtgtggattcagcatcttcaacagaatttttggttctgttttcttaatttatcctatagagtagtttcaggtactgatatttgtggatacttggaccaaatggaccatatcaaatattatgccagagattctgatccctaaactaagtagaataggcacttgatttataattgtgtcttaacaacatcgtttctctcttatcttgtgttactctttgtcatttattcctcacaggaagaaagaagtacctaaggccccaccattagaacctgactctgtgtttctaatgcttcaggccaaggaggaaaacactgtatttaatgcgcttgcagtatttctattcttgcaaaatacttactgttccaagcaagtgagttttcaaataaaataagaaaagcattttcctatttttgctgcttaccttattgctctataaccctctacaagtgtatctatttccaaatcgttttctctggggaggctacatttcacacttctacaacataaaatactaccacagagattcttaacagttgacatttgtagacctccttgattgaaaggttgtgcagtgaatacatttgttttggaatcaaataaatattatttaaatttggaaatagatacacttgtagagggttatagagcaataaggtaagcaccaaaaatacgagaatgcttttcttattctatctgaaaacccacttgcttggaacagtaagtattttgcaagaaaaaaattacctcaagcattttaagtacagtgttttcctccttggcctgaagcatcagaaccatagagtcagattctaatggtggggccttaggtacttctttctcaccgtgaggaataaatgacaaggagcaacacaagataaataaacctgttctaatctagagctaatatgatataatttacaaatgttctggttttaattttaaacaaattattctgcctgaccccatgtttttcattgcacactaatattgatatttgacacatcagattattagatattcataacatttgattcctttggctatcatggatcattcttttattcagtaaatatttatcgaaagccttaaatgagccaaactctattctgattctgggaatatagttggtaacaagacaaaaaagatcactgttcttgtggagtgaatattctcatgaggaaagagagacagtattcaaaatgtaagaggaatatgttagatagtgatgagtgctctgatgacaataaggcagagtctgatgatagggagggacttgggggctcctttggagtgagtaatccaagaagactggaatggcaagcagggaccactgctgtaaaatcagtgaaagagcatcccagatacagggaactgacagagctgcagtcaacaacctagaaccaggctgttcaaggcagagaatgcacgaatcacagattgctttatctagacaaaataatcaaaagatatcctggcattcccccttctgttggtgaggctccaagaccaacctcacaagacaaatggtaagactggtttgtttggtaagactggttttattaactactcataaagatggcagaagcaacagaattgactttcttgcatagtaaacaggagactagtctgtgagtgacctggagaagcttagtacggctgtggccagtttgatagttaataggttaattctgataattatcagctgagttgatagttaatcctatattgaaatcctggaggagaaagaatacaaaagagatgacatggaaaccagcttcttgttcgcacttgttactgagaaaacacactgcataacacacaggttaaacgctgtttgctgttcatggggctttaattggagggtcactcttctggatgtttgtatcacaagtgcattccagtggcactggcccaagctgttatttccaccttgtagctcatgtggttttgctatggtgctgatgtgcgtaaatgtggttgtttctgtggttttcttacaggtcctggagaattacatatcatgcaaaaggttataggtcagcttatctttgcagatatagaactaggtaaaactcccctaaaataccggtgcttagcaaagtaaccttgcaagtttactttgcccttcaatgatcaacaacaaaaaccaaccaactaaacaaacaaaaattagaactcattagcttaacgatccatcattcattaatactcttgagcttatggagaaaacaaccaatatataaaatattcttcaattgtacctgctgcttttatttcttttagaagtatttttttaagctgtacttttcctaaagcctgagaatattttgtgttatttttgatgccagaaaggataatataatacactgtatgtctttaattcgttgtaactggtggaaaaagagaaagataattgaaaccttaaaacagcagagataagtgatctaagttgtaaatctgttagtaattcaagaacatttagaaatatctcctgataaggttaattgaaggaatattctaatgaatgtagtaaattagttgttcccaatctcaaaatcttttaatattctgaaagaaattaagattttagtgagagatattccactttatggaactacttctttctccctttatctctttatggaaaattctatcttaaggagcaaggtgaatctttcttgttctcttttactgcaaaatatttgtttttaatatgtaactaacctgcacattgtgcacatgtaccctaaagcttaaagtataataatagtaaaataaaaaaaaattgtttttaaagcaaaacaaacttacatagaatcaataatttctgttattaaattatagaatgggaagatgtattgcttattgtgatgaccctcaaccctggctgcacattagaatctcctggaatggggcttccaaaccttagtgtgcttgtgaatcatctagggagtttgttaaaatgcagattttgatttaggacttctggggtaggacctgagagtctgcgtttataacaaactcacaagtgatgttgatgcttgattagcctgttctttcattgctataaagaaatacctgagactgggtaatttatgaagaaaagaggtttaattggctcccagttatgcgggctttgcaggaagaatgatgctggcatttgctcagcttctagggaggcctcaggaagcttccaatcatggcagaaggtgaagggggagcaggcacatcacatggcaaaagcaggagcaagtgagagagagtgggccaggggaggtgccacacactctaaaataaccagattccatgataactcactattacaaagacagcaccgaaccatgagggatctgcccccatgatcgaaacaccttctaccacgccccacctccagcactggggattacaatttaacatgagatttggttgggcacaaatatctgaactatatcctgccctgcacctcccaaatctcatgtgattcttacattgcaaaatacaatcatgccttcccaacagtcccttaaagtcttaactcattccaacattaactcattccaagtccttaactcattccaacattaactcaaagtccaaagtcttgccttgagacaaggcaaatcccttccacctatgagcttgtaaaataaaaaaaaagttagttacttccaagatacaatgggagtataggcattgggcaagtattcccattccaaaagggagaaatcggccaaaagaaaggggctacaggtcccatgaaagtttgaaacccagcagggcagttgttaaatcttaaagctctaaaataatctcctttgacttcattttccacatccagggcacactggtgcaagtggagggctcccaaggccttgggccgctccacccctgtggctttgcaggtttcagctcccagggttgttctcacaggttgttaaatacttgcagcttttctagacagagggtgcaagctgctagtagagctaccattcttgggtctggagggtggtggcctacttctcacagatccactaggcagtgccctagtggggactttgtttgaaggctccagcccacatttcccctttggcactgccccagtagaggtttactctgagtgttttgcccctggagcaagcttctgcctggaagctttctcaggcatcccctgaaatctagacagaggcccccaagcgttcatcacactctcacattctgtacatctacaggcttaacaccacatgggagccaccccaaggcttatatactccaaagtggcagctggagctatacctgggcctctttgagccacagctggagctgagctggagcagccaggatataaggagcagagtccctgggcctggcccacataaccgttcttcccttctaggtctctgggcctgtgatgagaggggttgctgtgaaggtctctgaaatgcctttgaggcttttttcttgttgtatttgttatcagcacctggctcccttttaattatgcaaatttttaattttgcatcaaattaaaccagcaagtggttgctccatagcctgcttgaattctccctaaaaagctttttctttctctgccacatggccaggctgtaaatttttcaaactttcatgctctgatttccttttaaatattaggttgatgccaaacaatcacagtttgcaaaaacaattacttttaattgcaaaaactgcaattgcttttgcaccaacctaatataaattccaactttaggtcatttttttgcacccacatcagagtgtaggctgttagaagccaccaggccacatcttgaacactttgctgcttagaaattttctcttccagataccttaaaccatcactttttagttcaaacttccacagatccctagagtataaacagaatgcagcgaagctctttgctagggcataacatacatgagctttgctacagttcccaattaagttcctcttttccatctgagaccttgacagcctggccttcactgtccatatctctgtaagcattttggtcacaaccatttaaccaatctctcagaaattccaaactttcccttatctacctgtcttcttctgagccctgcaaacacttccaacctctgcctgttactcagttccaaagttgcttccacattttcaggtatctttatagtaatactccactcctggtaacaattttccttattaggccattcttgccctgctataaagaaatacctgagactgggtaattaatttatttatttattttaaaaagaggtttaattagctcatagttctgcaggctttagaagaaacatggcactggcatctgcttagcttctagggaggcctcaggaagctcacagtcatggtggaagacgaaaggggagcagccaggtcacatggtgaaagcaggggcaagtgacagagagaataggtaggaaggtgccacacactttgaaatgagcagatctcagaagaacttacactgactatcatgaagagatcaccaagccataaaggatccactcccatgattcaaacatctcccaccagtttccatctccagcactgtagattataattcaacatgagatttgggcagggacaaatattcaaactatatcatgtaggctttacaggaagcatgatgctggcatctgctttctaaggaggccttgggaagttttcagtcatggcagaaggtgaaagagggagcagatgcatcacatggcaaaatctggagcaagcaatagagaatggtgggggagggggacgacacacacttttaaatgaccagatcttgtgagaaagcactatcataaagacagcaccaagcaatgagggatcttcccgcatgatccaaacacctcccgccagactctacctccaacatagaggattacaatttaacatgagatttgagcagggacaaatatccagactatatcaatgctgttggtctgtggaccataatttgaatagcaaggagagagagcttttagaaattaccaatacaaaggccaagacacccatatatttggattcatggtatctaacacggggtccagaaatctgcatgttaacagaaacaacatgtgattgtaatgcatataatccacagatgggagtttggtctggctagaaggcagtactagccctgattgtgtacaggattagaatcccatgcaaatcattaaggctgtaattcctgtgcctctgtagtcttaatatttttatagcagatgctgatgtaaaaaaccactattctgggcattcaggaaagaacactatcattgtatgaacttagtgaaatgatgtgggaattttgagtgtatgcacaatcataaggttgtggttcatagctattaattgaatctttcttaaaatgtttttttgtataaatatatgggatacaagtgtaattttgttacatggatagattgtataccggcttgtatactggtgatgtcagggcttttaggatatccatcacctgaataatgtacattgcatccactaagtaatttcccatcatccacccaccctcccatctccccacccttcatgtctccattgtctatcattccacactctatgtccatgtgtacacattgtttagctcctacttataagtgagaacatgctctcttgctaccaattaattttttctttaagaattttcagattttactttagatatatgtgcaggtttattatacaggaatatagcatgaggctaaggtttggagtatggatcctgtggctcagatagtgagcattttacccaatgggtagcttttcaacccccattcctcttcctcccttcccacctctagtagtctacactttcgattgtttccaaatttatgtccatgtgtgctcaatgtttagctcccacttataagcgagaatacatggtatttggttttctgtgtctgtatttgtttgcttaggattatgacctgcagctgcattcatgttgccgcaaaggacatgatttcatcctttttatggctgtgtagtattacatcttgtatatgtaccacattttctttatccaatctaccactgatgggcacctgagttgattccatgtctttgctattgtgaatagcacagcaattaacacatgactgcatgtgtctttttggtagaatgatatatttttccttgggtatatacctaataattggattgctggattgaatggtagctctgttttaagttctttgagaaatctccagactactttcctcagtgactggactaatttgcattcctaccaagagcatatgagcgttcccttttctctgcagcctcaccagcatatgttgttttttgactttttaataagagccattctaactgggtgagatggtatcttattgtggttttgatttgcatttctctgatgatttgtagtgctgagcatttttccatgtatttgttggctacttgaatgtcttcctttaagaagtgtttgttcatatcctttgccattttttaatggggtttttttttgcttgttgatttaagttccctatagattctgttaataggcctttgtcagatgcatagtttgtgaatattttctcccattctgtaagttgtatgtttactctgttaatagtttcttttgctttgcagaagctctttagaaataagaaatgttgccaattaaataatgagatactaattatgagaagacttaatctaattttaaagatgttaaaaattttttaaatatgccctggagtcaatgaagtatattattcaattatggaaattctctgtacatagaacagttcaggaacacaaagttatctaaagagagtttggatttttacatagctcacctattttttattataatgtttctcatatggacaatgtatagtcaaggtgaaaacacagttctaattctgttcagggaaaaaaatagtagaaattagtttcctccattctgttctatattactatttaaatttagtttgttaaaggcttaaagtttaacttcacaaacatacaaaatcatagttttttgttaaataacaacatttgaattgtataaatatattattgtatttcttaatttataaactatattagcaactagaaagaaaaaaaaatgacttagaagatattttacacatttacttacattctttatgcaacctgaaccctcatctctttttaacattagggatgacagtgggtggacagtgggtggatctgaatttttaaagttattctctagcaactagaggaaaaatcttaccagattatataggctagaactcttgattgagaagacagagtattattaaggttctgaaagaagagcttttcattattcaccagcaggttttactatctaaaatagaattacatgaatttgtaaaatttgtcaccaaaagcttcatctacttgtaaataaaaaaatcctctcaatttttggccaggtgcagtggcttacacctgtaatcccagcactttgggaagctgaggtagatggagctcttgagcccaggagttctaaaccagcttgggcaacatggcaaaatcccgtctctacaataactgcacccttaaaaaaatagctggtggtgtatgcctatagtcccagctacttgggagactgaggtgggaagatcacttgggctctggagttcaaggcgatactgagctgtgattatgccactgcactccagcctgggcaacagagcaagacctgtctcaaaaaataaataaataaatatataaatatataaaataaaaaaataaaacttctgtcaattttggataggtataaacatcatgaaaaatagtttgaaaatttataactgagaagttgctgaaaatccttgatcggatctctgcttgcaatttctgcataaaagattttgagaatatatgcaatgcaaaataaagcattccatattttaaaagaaaaatattttcttgtcttaactatgtatactttttttatttgagagaagttgctcaaatataatatagttgttgactcaagagaatcaataaaaaaaatctactgaataaataacacagtttataaaatggttagttatgacatcattgccttcctcatacaaagaatgacctgttagaaattctaataaaaaagaatcctcttgtagtagcaacaaaaattataaaatgcctaagaacaaattttaatagagatatagaggccctatacagttaaaaattccaaaatgttaataatgagattataatacttgaataattttttaaaatacgtttaatttttccataggttattggggtacaggtggtatttagttacatgagtaagttcttcagtggtgatttgtgagattttggtccacccatcactcgagcagtatacactgcaccctattgatagtcttttatcccttctcccctcctacctttcccctcaagtccccaaagtccattgtatcattcttatgcctttgcgtcctcatagcttagctcctatatagcagtgagaacatacgatgtttggttttttattcctgagttacttcactaaaataatagtcgtcaatctcatccaggttgctgcaaatgccgttaattcattccttttgatggatgagtagtattccatcgtataaatatatataccacagtttctttatccactcgttgattgatgggaatttaggttggttccatgattttgcaattgcgaattgtgctgctataaacatgtgtgtgcaagtatctttttcatataatgacttcttttcctctgggtagatacccagtagaggaactgctggatcaaatggtagttctacttttagctctttaaggaatctccacactgttttctatagcagttgtactggtttacattcccaccagcagtgtagaagtgttccttgatcaccacatccatgccaacatctattgttttttgattttttgattatggccattcttgccggagtaaggtggtatcacattgtagttttgatttgcatttccctgatcattagtgatgttgggcattttgtcatatgtttgttgtccatttgcatatcttcttttgagaattgtctattcattccttagcccactttttgatgggattgtttgtttctttttttgctgatttgtttgaattcattgtgattctggatattagtcctttgtcaaatgtataggttgtgaagattttttcctactctgtgggttgtctgtttactctgctgactgttccttttgctgtgcaaaagctctttagtttaattaagtcccagatgtttatctttgtttttatcgtatttgcttttgggttcttgatcatgaaatctttgcctaagccaatgtctagaagggtttttctgatgttatattctagaatttttatagtttatagttttatagttatacttaagtccttaattcatcctgtgttgatttttgtataaggtgaaagacgaggatccaatttcattctcctacatgtagctagccaattatcccagcaccatttgttgaaaagggtgtcctttccccactttatgtttttatttgccttgttgaaggtcagttggctgtaagtatttgggtttatttctgggttctctattctattccactggtctatgtgcctatttttataccagtgccatgctactttggtgactatggtcatatagtatagtttgaaatcgggtagtgtgatgcttctagatttgttctttttgcttagtcttgttttggctatgtgggctctttttttgttccatgtgaattttagaatagtttttttctggccaggtgcagtggcccacacctgcaatcccagcactttgggaggctgaggcagagggatcacctgaggtcaggagtttgagaccagcctggccaacatggcaaaactctgtctctactaaaattacaaaaattagccaggtgtggtggtgggcacctgtaattccagctactggggaggctgaggcaggagaatagcttgagcccaggcgccagaggttgcagtgagctgagattacaccattgcactccagcctggtgacaaccatgagactctgtctcaaaaaaacaaaacaaaacaaaacaaaaaaccaaaaagaatagtttttctaattctgtaaagaatgatggtggtattttgataggggttgcgttaaatttgtcgattgcttttggcagtgtggtcattttcacaatattgattctacctatccatgagcatgtgatatgtttccatttgtttgtgtcatctatgaattttttcagcagcgttttatagttttccttgtagaggtctttcaccacttggttagtatatttctaagtttttttttttgcagctgttgtaaaaggggttgagttcttgatttgattctctgcttggttgctgttggtgtacaggagaccttctgatttgtgtatgttaatcttgtatccagaaactttgctgaattctttgatcagttctaggacctttctggaggagtctttagggttttcaaggtaaaggatcatatcatcagcaaacagtgacagtttgacttcccgtttaccaatttggatgtcctttatttctttctcttgtctgattgctctggctaggacttccagtagtgtgttgaagagtagtggtgggagtgggcatccttgccttgttccaattatgagaggaaatgctttcaacttttccccattcagtattatgttggctctgggtttgtcatagatagttttattacattgaggtatgtcccttatatgccgattttgctgagagttttaagaattttaatcataaagggatgctggattttgtcaaatgctttttctgcatttattgagatgatcatgtgatttttgtttttaattctgtttatgtggtgtatcacatttattgacttgcatgtgttaaactatccctgcgttcctggtataaaacccacttaatcatggtggattatctttttgatatgttgttggatttggttagctactatttcgttaaggattttagcatctgtgttcttcagggatatcttcagggtctgtagtttttttttttttctttctttttttggttatgtccctccctggttttggtattagggtgatgctggcttcatagaatgaattagaaagggttccctctttctctatcttgtgaaatagcatcaataggattggtaccaattcttctttgaatgtctggtagaattctgctgtgaatccatctggccctggactttattttgttggtaatttttaaattaccatttcaatcttgctgcttgttattggcctgtttagggtatctatttcttcctgatttaaccttggaggtttgtatttttctaggaatttattcatctcttctaggttttcaaatttatgtgcataaaggtatctcatagtagccttgaatgatcttttgtatttctgtggtgtcagttgtaatatctcccgttttgtttcttattgaggttatttggattttctctcttcttttcttggttgatcttgctaatgatatatcaattttatttatcttttcaaagtaccagctgtttgtgtttcatttatctattgtatttttcttgtttcaatttcatttagttctgctctgatcttggttattttctttcttctactgagttttggtttggtttgttcttgtttctctagttccttgaggtgtgaccttaaatgtcagtttgtgctctttgagtctttttgatgtaggcatttagggctatgaactttcctcttagcactgcctttgctgtatctcagaggttttgatagattgtgtcactattgtcattcagttcaaagaatttttaaatttccatcgtgattttatttttgacccaatgatcattcgggaccaggttatttaatttccatgtatttacatggttttgaaggttccttttggagttgatttccagttttattccgctgtagtctgagagagtgcttgatataatttcaattttcttaaatttattgaggctcattttgtggcctattgaataggccacatgtgctgttgaatagaatgtgtattctgcagttgttgaatgaaatgttctgtatatatctgttaagtccattcattccaagatatggtttaaatccattgtttctttgttgacttcctgtcttgatgacctatctagtgctgtcagtggagtattaaagtcccccactattattgtgttgctgtctatctcatttcttaggtctattagtaattgctttataaatttgggagctccagtgttaggtgcatatatgtttaggattgtgatattttcctgttggacaaggccttttaccattatataatgtccctctttgcctattttttcactgctgttgctttaaagttggttttgtctgatataagaatagctacctctgctcgcttttggtgtccatttgcatgaaacgacttgttccacccctttactttaagtttatgtgagtccttatgtattaggtgagtctcttgaaggcagcagatagttggttggtgaattcttatccattctacagttctgtatcttttaagtggagcatttaggccatttacattcaatgttaatattgagatgtgagttaccattccattcatcgtgctatttgttgcctgtataccttggttttttgtttttgtttttgctttttaaattgtatttttattgtataggtcctgtgagatttatgctttaaagaggttctgttttgatgtgtttccaggatttgtttcaaaatttagagatccttttagcagttcttatagtgccagcttggtagtggcaaattctcttagcatttgtttgtctgaaaaagactgtatcttttcttcatatatgatgcttaatttcactagacacaaaattctgggctgatacttgttttgtttgaggaggctgaagacagggccccaatcccttctaacttgtagggtttctgctgagaaatctgctgttaatctgataggttttcctttattggttacatggtgcttttacctcacagctcttaagagtctttcctttgccttaactttagataacctgatgacaatgtgtctaggcgatgattttttttttgcaataaatttcccgggtgcttttcgtggcttcttttatttggatgtctgggtctgtagcaaggctgggccgttttcctctgttattcccctaaatatattttccaaattttttatttctcttcttttgcaggaacagtgattattcttaggtttggttgtttagcataatcccagatttcttggaataagaatattttcttattcttttttctttgtctttattggattgggttaattcaaagacttttgagctctgaatttctttttttctacttgttcaattctgttgctgagactttccagagcattttgcatttctatatgtgtatccaatgtttccttaagtttttattgttttttctttatgctatagatttccttgaatatttctcccttcacttcttttattgttttttggatttccttgcattgggctttgcctttctctggtgcctccctgattagcttaataactaacctcctgaattctttttcaggtaaatcagagatttattcttagtttggatccattgctggtgagctagtgtgattttgggggatgttaaagagccttgttttgtcacattaccagagttgtttttctgtttctttctcatttgggtagcctctgtcagagggaaggtctagggctgaaggctgttttcagattcttttgtcctacgaggtgttccctggatgtagtactctccccgtttacctatgggtgtggcttcctgagcagagctgtagagattattatttctcttctgggtctggccaccaatatgtcttccaggctctgggctggtactgggggttgtctgcacagagccctgtgatgtgaactgtctatggatctcacagccgtggataccagcacctgttctggtggaggtggcaggggggtgaaacagactctgtgagggctcttagctttgatggtttaatgctctgtttttgtgctggttggcctccgaggccaggaggtggtgctttccagagagcatcagctgtagtagtatggagaggaactggcagtgggccaggcccttgagctcccaagagtatataccctttgtcttcagctaccagggtgggtagtgaaggaccatctgatgggggcagggtaggcatgtctgagctcagactctccttgggcgggtcttgctgtggctgctgtgggggatgcggatgagatttccaggtcaatgaaattgtgtacctaggagaattatggctgcctctgctgagtcatgcaagttgtcagggaagtggaggaaagccggcagtcataggcttcacccagctcccatgcaatctgaagggccagtctcactcccattttgcccctgatagagcactgggtctgtttccagatagtggggaagcagagctgagagcttgtcccagactacctgcctccaagctgcagaagaaaaggaggcttctcaactggttcaaattgttacgaagttcagctggagacttccttctccctgtggcatttatcccgtgccactggaccccctcccaaagtatccctgtgacactcccatggtctttcctgctgcttcctctacccctgtatttcactgggctctctaaattgattcagctccagttaaggttggaatcttctcccacagactagacttttagtttccccagtgtgggtgtgagtttaggggtggaggatctccctttcccacttccgcagtttgggcactcacagtatgtggggtgacttctgggtcctgcaggagcagtccgtttccttcagaaggtctgtgggtcctcttgggattcctgatttattcctgcagtcattctggagctaaaactcatgatgcaagcctccacatgctgctgtatccatgcgagtccaagctgcaatctagtcctgcctcccatctgccatgacgatcctaggtatagtcatatctaatacctgaatcatttagaatatatgtcatatctctagataagaagactaaatatcataaaatatctattttctctaaatcagatccaaatgaatttttttcaaaactcaaatgcttttaaaattaatttgcaagaataaatttctaaaatgtcatacacaatttttgaattaaaacaaataatcagtgtagacttcctcactaaaatttaaaatttcataaagtttatctgataaaaaataactcacaggagcacttgcatagaaaaagactaataactcagtgacacacaatatataggaacaaatgcaagcattttgggagaatttagtacatgatgcacatattatttaaaattggtggaattaagatgaattattcagcaaatgtattggaataactggctattaaaaataacattcaattttatacttcatatttttactccaaaatatattccagatataataaatatttaagtgtaaacccagaaacaatgtaagtactaaaaggaaatataggtgaatatttttaaaatcttgggatgggaggaaggtctttcaacgtaggtgatcaaggacaaagttaataagaatattgatagatttaactgaatgattttataatctttgcactaaaatcagcatataaggataaaatacaaataatatgctaagaaaatatttcagggtatataacagatgagatgcatcattaataggagttattacaaattaataataaagtttacaattctaacaaaaatgatcagtggcatgagcagggaagccataaaagaaatgtaaaggcacaaaaaacatgaaaagtaaccaaatacactgaaattaatggagatcttgtatcagttagctatttttgtgtaacaaacattcccaaaactcaatggttacaacagcaattatctgttgtaataatttacatttctttttgttgtctgagggtttgttggctgctttaggatgagcttaactgagcttgctcttgtttctgtatgcaggctgggggcctgtctctaagttgggctttcctgggacaatttagctggggcattcctgctccatttgtctttcatactctgcaagggctccatgtatttctcatcctttttctgggaccaatgagccagcccaagcatgtccttcttgtggaaatggcagaagtacaagagtgcaagcctagctggacaagtgtttcttaagctgctgcttgtgtcacatatgctaacatcccattggctaaatggcaattacatgaccaaactcagaatcaaggggaaaggaaatatatcttgtcttttaataggacaaactaaaaagtcatatgataaaggacatggatacaagcaagtgcaaagatttggggccattaatacaatataccagatgccgtcttttgcacgttggttagtagaagtgttttgtttttgttttttttttttttaaccttgcttgtaatagtcagtgtcgtcaagagtgttaggaaatgagtactcccacacactgctgaaggtgggagtctaaatggctaattggagtgacaatttgagtgtgtgtttcaaaattttattaaaggtgtgtgttttgggctcaatacttccatttttaagaatttactacaggaaaataattaggcaaatgtgcaaaggttgtataagtataaacctggttaatatagagccagttgtcatggcagcaggaggccatgtggagcagcggctgccatcaatcctggctgcagcagagaggtgtggctttggctgtatgcttcatggaactggtgggaactgggaacaagtgggagccctgccccttctgagttggggcaggagctccctgggtgccactgaagatgcccaagccacagcagtagacctgggcattcctgtgctctttgggcccaggagcaggcgggaggctcaccctcctgggcatagctgcagccactcaaactgtggctgcaggcccatgcctcctgctccatggagcaggcaggagccccatcccccagagtgtggctgcagctacccaaaccgtggctgtagacccaggcatctgtgcactcttaggcggtcttgagaaggcccccactgatcttacgggctcagaagtacctgttcccactgcctggtttctctctgctgttagcacctgcttctttcttggagcaaagatagggccaagcccaggcactgtcacagcccagctgggtgtgtgcacacttggggcagtgctgacatgccagcccctggtcaccttagccccctccagactttgggcactgatgagcataggaggaaagctgaggcaggctgagtgcagctcagtgctggcctgcaggtaccccttggcttctacagcctgggtgccctgaatgacagattgaggtagacaggttactggatggaagggggcaggtcacaggtgaggtcccagccttcaaagagagcctgaaggctggggactaggctgccagtaccgccggactggagtggaaacttgtggtgcattttccgggcctgcccatggccacccatggacaaattggtgtacacttcctcccctctgaggcccataaaaacccctggcttagccaaagcttagcagatattgaggtgaccagctgcatagaggagcaacacactctagggcctcctctctgctgagagctatagagacaatgagatgacctgcctgcagagaggagctacccactttagggcctcctctctgctgagagccacagagatgaaggagagatgacagggagatgatgggactacctgcctgcagagaggagcaccccattctagggcctcttctctgctgagagctgcacagacaatgggacgaccagctgcagagaggagctaccttctctgctgatacctgaatacttgtcaggatgacttgccttgaatacttgtcaggatgacttgcctagcagaaaggagcaaccctctctgctagaagctgaacacactttggggaaaccctggctgtggaaaggagctgccctctgagggtttcctctgagccattttattgctcagtaaacctcctcttcaccttgctcaccctacactttgctgcatacctcattcttcttaggtgtaggacaagaactcgggacccactgaatgaggctaaaagagctgtaacacaaatgaggctgagatatgccccattgctcaccacattgcaaacaaagagaaggaaagaagagctgcagcctttcagagagcccagacctgtgagctccccaagccagggctgtgactccctctttgggttcccggcatttccaagctactgggcatcaccatgttccctggtgccagctgcggaagctgctttcggtgcacctggtccagccgcagccttgtggaaagccgactctcatgctggcacctggagcttcctgccttgctgcagcagctggcatgtctgactgcacagtggctggaccccatgctcactcacatatcccttgtgctccacacagtctcccttggcagatgtgggatccaggctggtagtgtgagctgagcgcatcctgccaggccaagtgggcggaatgagcccagcgggcctgagtgaaactcaaggcaaaggcatcactggccacagaggtttctggccagaaaagtgacaccccaaagatcctgtaacagttgcacatgtaaggctatactttttaaaaaagttgacatcaattttgattgattgattgatatttcagcctgttatatattttaaatatcacctctgagttcaatgatattaatcactagattgtttataatagtaaacatttggaaaatttctaagttccattaatataaaattgataaaaataaatgttggtacatccacacaatgggttgctatacaactgttaagataatgatgcttgtatttattgtcatgaaagaaatccatgccataatgattaaatgtaaggtaggggcttgtttcaataatatatatggttgtatgttcattaaatatatgaaaaagtatttatcagggtatttctatgtggaaaattatgggtgcttttattttcttattgtgctttttaatgttttatttgtagtgtcatgcattaacaggcactttttatgaccattaaaagacagaaagtctacttctatttttgaaaagtgatattgagaatttaattgtaattagtttcaaggaaagcgtatgagtaacaatactctgttacaaagtcaaaacattccgtagaaaatagctatgagtcttaaaggaaagacttctctagtcatatcataaatgatgtctgtttcccttttgagcaaagagacacaacttaataaaattaataggggaaactcaaatgtatagaaaatagaatatgagtaagaaaggcatggatacttttatgctgtttatatacacatgtacacccagccatgctttctgtaaaaatagtgcttgcttggttctgtaaaaggaggaaatatttcagagtttatggcaaaatcattttggaagtacagaaggttggtttggaaaggattacacatttgtcatactttctttcatgcttaataaaaaaagtgattctgatctgatgaatggaacattgttagaagtcagaaaatattactgtttctcattatacttttcatttgtcacatgactttaatgaaggaccctcctgttagcatgagagtcattatcaaccaaaggtatatagaacgtttcctctttaatgcagacatttaacaaactaatgaatactaaaaataaaactctctaaaaataatgttgcttatatactgtgaggatctgctaaatcttttctgcttttgaatacacagtaagaaaattaatttagagcttaatcagccatcataagcagcagcaggtaattttatttaatttttcaaagcaatgagagactattggagtgggagcaggcatgcaggtaataaagaactctttgatttttattgaaacatccataatttaaatgacaggttttgcggattcaagactagtggtttgcagagggtgctctgcagagcctcttgggttccatgacattaccttggggcccactgagggtggtggttggaagaggaggaggctcctggctcccatgtccacatcctccactgtagctctaatttcataggttttgtatttcaatgttctgtgtgagttggcgtgaaaaatgagttctattgcaaaaatagttttgaaaacctttaatttgttccatctccacagtgtgtagatgaagaaacagattcaaagtagactcctgctctattttagtgattattaactcctggtaggtgtaagaatgcacaaaatgcttcagtcatcacaccaatcctgttacctaggctgagtaaatatcagcaccattgtttgccagattaggaaatggacactcagagggtttcaacaatctgcccacgagatggtatgcctaactcctagtcctgcttctcctccttctattccttctttaaagtactttttatctgaccaggctgtgtggttctctatgtttgtacatgttccaacccagagaagttgtagtgtataattgatagtattttaaaatgattccactgaagctgccattattagaaatgattgatctctaaacagcagcactatgtatgaatatgtccaataatgacaaactctaaccagtaagtgctcagaatagtgtgaaagttttatttagcaattttacaagattggtgtggagaatatatacaaattgctttctgtgtttttcttttttagcaggttttaataaatgatatatttataattttaaaagttatattaaagacctataatttgaacattgtagcattgcaagcataaatgttctttatgtttacaaaaaacctcaatggtattcttgattttaaattggtctttgtgtatattatattcctctcaagtgcactaaatttctatagattctgtatgttcattaaaaatatttgctcagttcaattacagttattgggattaggggtagcgggtggggaaaatgtgtaagttcctgaggcttccctaaatgggatgtcctctctgtggattgagacatgtccaaaaacccacatcgaaccttcaaggatctattacttgaggggcctgagagtctatgaaaaacaggcattttaagaagagtcctggctcaaattttgtttcatatctcgtcatatcaaaataaataagaataaaaaattacaataattgtgttatttttctatgtgaatatatatacacacagcagattttatttaaccatttcctctgttattaaggaacttaaaacatttaagatatttccgaatcttcgccattgtttaaaataacactgaaatgagcatctgggtgcatatgtaattgcattcatctctaataatttccattggaaagattcctattaatgacattgtcgtactaatttactctttcatcaatttaaaataatccttatactgccaaattttactaatattgaattatacattattttactaatattgctgatgaaaaattgtgtcctggtgactttttttcatatatctaccagtatgtttttgtcatctgtaagtggcatggagagcttataatttttgacatctctgatttatgtaaaatcatatatggaattagagaacctatgacattaaattaggttatctctggattgagaaatggtgatatttgttttcctcattctttttgtgagtttctgcccataaaatattttataataaaaatgcaaaaaagatgaaggtatctttttttacaaaacagcatacagtaagacaagattcatgtgtattatctaacatttatgaaattttattattaagtgtttttagaggacttattcaacatatgaaggattttagtcagtagacacagtgcctcttcacctgcactggaggcgttgtttttcttctctgtagcagggtgaatggggtaggatggtaaaaatttccactgagaatgtagcaaacttgatgtcttcaaaacagctccagcatttgtgagatgatgaatactccacatgaaagaggagacacagcgcagtggttagtgcacagccctggagtcgaaatccttagatattactccaggctttaccacttcttatgtgaccttgagcaagataaattttttatgcctcagtttcctcatctgtgaaatggggatataaacagaacctatatcttaagggtattataaagattaaatgaggtaactatgcagaaaacgtttagaaattctgacaataaattgttttaaaatggcaattataactttagtaagtggtctcatattctctctttttttaaaaattttactttaagttctggggtacatgtgcagaacatgcaggtttgttacataggtgtacatgtgccttagcagtgtgctgatcacggtcttcttatgcacatttaccaatttcagtttgttgaaagacacaattatcagatatttgaatgtggatgaggtttgttgtaattacaatttcacttgccttttgtgaatgtttctgtcacaccagggcatggggatgacatgaacaaaggcagagcagtggaaaagcataaacttgttcagggaatagtaaaaaatctaggtaaatccacaacataatgctattgtaacatactattaattatgttaattaaacaattattcatgtttggtcttcatgtcaagatgaaatatatttaaatacttgactttataacatatataatattgatgtaatatcataaaatatttgtaaaataaacacagttatataccatgtaaatatatttcatgtattcattctaatctaccgccaagtagtaaagtttcagatttttttttttttttgagacagagtcttgctctgttgcccaggctggagtgcaatggcatgatcttggctcactgcaacctccgcctcccaagttcaagcaattctcgtgcctcaccctcccgagtggctgggattacaggcgtgagccactacgccccactaattttggtatttttagtagagacggggtttcgccatgttggtcaggctgatctcgagctcccgacctcagatgatccgcctgcctcggccttccaaagtgctgggattacaggcatgagccactgcgcccagccttggataatttttaactctggaggagcagaaatgaagcactgtccggaataattttcctactagagaagcaagtgatgaccctgcgttacaaggggtttatatgctggcctagtatctatgttctctagatggcagtggtaggatctcactcccataacacccaagagtcactgcattataaggaacctagaattgctttcttttttttccgagaccgagtttcactctgtcacccaggctggagtgcagtggcgtgatctcggctcactgcaacctccgcctcctgagttcaagcaattctactgcctccgcctcctgagtagctaggattacaggcgtgtgccaccatgcctggctaatttttgtattttgagtagagacggggtttcaccacattggtcaggctggtctcgaactcctgacctcgtgatccgcccacctcggcctcccaaaattctgggattacaggcaagcgccaccgtgcccagcctagagttgctttcttaaaagcatccattatgtattagagaatacattacaacatttgcgatgaataatcaagcaaagattcaatatatcaccctgtttaaagtggaaatccacctccaatgattttgctgataatgatagaatgatataatttcaaaaatcattcttttaatttttgcattataaaaatttttgggccatgtgcggtggctcacgcctgtaatcctagcactttgggaggcctaggcgggtggatcacttgtggtcaggagttcaagaccagcctggccaacatagtgaaaccccgtctctaccaaaaatacaaaaattagccaggcatggtggcgggtgcctgtaatccaagctactctgtaggctgaggcaggagaaacgcttaaacccaggaggcagaagttgcagtgagccgagattgtgccactgcactccagcctgggagacagagcaagactccgtctcgataaataaataaataaataaataaataaataaataaataaataaatatttgatatgagtgatggactaaaaatctcaactaaatattcctgggactcttcattctgttctctaacagaaccttcaaagtgtattttggaaaaattccattaacacgctgcctaggctgaaataatttcatgatcagtttcatttttgcactcaccttgtaaatccagacctccaggcaggtgtcgggcagttatcagtggattaatctggtcagctgcttctggttgctgttttaaggttactacctaatgtgtacttttagagactctccctagtgtgctgtcacaaagaagtcgattggatttttatgtaaagaagggctcggtgagcctctaatccttaaatcattcctttgaccacattttatttcattgtaaatggagattaccacacagaggaatatctgatgctgtctggctgatccatttctaactaaacaattaagtcacttgtatgtcagagcatactctcagcaactggcatttccattacttcaggcttaccctgagactattttggaaatatttcatcttctgctattttttttctagacatttgttattttatttttagattgacagacaaaattgtatatcttcatctgtacaacgtgatgttttgaagtgcatatgcattgtgaaatgaatgaatgtagctaattaacgtatgcattacctcacataatcatcacgtttttgtggtgaggacacttaacatccactctctgagcattttgcaggaatacaatatattgttattaactctggttacaatgttgtacaatagaactcttcaatttattccttctatttaactgaaatcttgtaccctttgaccaatgtcaccccaagcaccccacctgcaactgcaactgcccccactcctctactctctagttccaggagattaatttttttacattccacatatgaaggagatcatatatttgtctttttgtgcctggcttatttcacttaacataatgtcctttaggttcatccatgttgttaaaaatggcaggatttccttctttttttatggctgaatagtgtttcattatgtttctatatgacagtttctttatccattcactgatggagtcaggtggattccatttttttggctattaggaataatgctgcagtgaacatgaaagtacaaataactctgacatactgatttcatttcctttggatatatacatgattatatccaccagtgggattgctggattgtatggtagttctatttgtaattgttttgagaaacttctatattgttttccataatggttgtactaatttttattcccaccaacagtgtgcaaggtgggtcattcacatcctggccaacacttatcttttgtctttttgataatagacactaatgggattttctcatacacatttaccaaacttcagtttgctgcagaacacaattaccagatatttcagtgggggcaagggttgttgtaattacaatttcacttgccttttgtgaatgtccctgtgataccaaggcatgggaatgacatgtgtagaggcagaacaatatcactccataaagatatcatctctcattgtgattttaatttgcattttcctgataattagtgatgttgagcatttttttcacataccagttggatatttgtatgtcttattttaagagatgtttatttaggtcctttgcccatttttaaattgggtttttcgttttcttgacttaagccccttaaatattttggctattaaccctttatcaggtgtatagtttgcaaatatcttctcccattgcgttggttgtttcttcactctgttgattgtttactttattgtgcagaagctttttactttgatgtaatactgcttgtctatttttgcttttgttgcctgtgcttcgggggtcatatccaaaaaatcattgcccagaccaatgtaatagagcttttcccctatgttttcttccagtagtttcatagcttcaggttttacatttaagtctctactccagtttgagttgattttcgtatatggtgtgagagaagagtctattttcattcttttgcatgtggatattcagttttcccaacaccatttattgaagagattgtcctttcctcactgtgtgttcttggcacttttgttgaaaatgagttggctggaaaagcctggatttatttctgggctctctattctgttccacttgttgtgtctgtttttatgcctgtaccatgctattttgattactatagatttgtagactattttgaattcaggtagtgaatacgtgctaattttcaattagcagaaagctcaagcaaaacaccctgagtataaatgaagcagctctttatgtggccttcacgaggattggactctcatagggcttggtttttgtataactcttagttttaactacatcctaaggttctagagaaaattctggagctgagacttagctatgcatttgtacaacttccttgtctgccaatctaaaagtcaatcttactgataatccctatttttcttttattcttatttcctcttaccattgtttagtagctaatatactatgtatttcacttgcttatgtgtttattgtctgtcaaccccatcatagctccatgagcatagcaccacgggggcagaaattatctactttgttcattgtcatagtcacagtgtcaagaaaagtgtctggcacattgcatgtgtataataaataattttgaataacagccagtcaccctattttatatatcctattttagtatcttggcatgggagataatttcatgagtatttatatatttgcaaactttggaagaaaaaaagaaaaaacactctatagaaggcaaattgagaggactgaaagtttagaagtgacaaacaacctagaaatagctacacatttttagtgatcaaaatcaatttttgtcattaatctggatttactaacttctcaaagttatcatggatgtaaaagtggctttaatctgctgatgctctgtggtgttctacaaaattgctaaattgcttttatgtgaaactggataagacataacccttctcctaccttttatattattttttagccatgagccaaatttttctagctaagccaatttaaaaaatattagaaatgcaaatgtattgccattgttctaaaatgtagttttaaaattccatttttcaaggtgggatttgtgattatgtgtgaggcgcttcattgtctctcagcacttcccaaccaaaatcagtccattttgccactcctgaggaaaggtctgctctgtgtgactcacagttacttccatgaatatttatcctgcctgtactgttggaatcaccttgagatcatgtacaattagttagggttgatagaattagtaatgttactggttgtgttacagcatctacgggtctcagtgaagtgggactcagtcccttctccccattactctattttctgtcccttcttgattctgcttgccattttgggggtgccaatttatttccttagtaaaaacaacagtagttatatattaagatacaactgtattatttgctttttttcttaaatccactattattttttgtcttttcattgattaaacttcaggcaaaactcatttggctgtgttgaataacattttgcaattttcttttccctgtgtctttcacactttgtagcattgtgctcatgtatactgtctttgtaagttcgaatctattaagtgatggttcgtcataaatcctgtataatacttgattttcatcatttatttatattttgtcacctgtactctcttgtcctgagtacaaagaatacacattcatctctgtaccttttttgtttattgatagtttatactttctttggacaacttttaaatgtatatttatttatatttgcttatccaatcttataaagaacaatttcacaagtagttagtccctgctcatcttcttttgatattcctaatatagtcttgtaatggattacttgggatatttattcctctgtattttaaaatcatgaatctcaaacatctctatccaccaaagaatcttttgaactaaaaaacgcacacagacagaccacatttttgaaggattcaatttcaaaataaagttagttcctacttagccttgcaaaatgaggtatcttctcttgataaagttgtgcaaataatgaatttcaatcattgaatattctaaaaatgtgttatcttgcctaagtaattgtttctatgcctttagctattaaaaatatgaaaacataatcctttataaaagcacatatttttaccttccatttgagtaatttttattagtcaaggaattttgtataggtatatatttggtgaaactttttaataaaattgtgtttttctggttataaaatgatgcagtttcattaaaaacatttataaagcagaaaaatacatagaatataaaaatcatccatattttcatagccagcaaatcattgttatcttaaaagtacatgtctataaacaataatttttaatggaattgggatcatttataagttcatttactacttgtctcttaacaataatgtataatctaatggttagtggaaaattcatcatatgatgttttcactatttaataaattcctcattcttagacatttagattgttttcatatttttcactgttatatataatgatgtgatgaacatttttgaaaataaataatcatagggttttctcttaactgccttacatacttcatttggagttaaatcactgagtaaaaagattcacatctcctcccacactctgccttctcttatgtgatttagtaccttttgcttgccttaatctctttctgcaaagtaagaaagtgatctgaaaaactaatttatatacagtgttgttaacttgtacgtgttttcctgcccctttcccttgctcagctgtcctagaccaattttgggaagcagactccacagacagaggtttatttgcaggagatttagtggggaatgttgtcagcaacaatacaattaagggagtaagggaagggggttgagcaggagaggctgaactcgggtgcaataacaggaaggtctccagccatcccaaggggagctctggagctcagaaggaccctcagagtgttcttgaattgaaatacatctctgaatccaacttcctcctgccactcccattgaccagtccttagtttggtatagggtgccttgggcaaggcagtggacatgctcagtagctgggtaagatgaggacttcatcccaaagtggccgtctgggcagtgaaccactgggtgttcagcgtatcagcctcgtggattttgtgttatcaaccaataaggggagagggggtgaagtgtaagtcaaaacagatgattctccactaggaaaattttagtctttcttgcctgttacctaaattggaaaatgtacatgaggaggatcttcctcagatcttgtcggcctctttctcataatcctgctctagaactcgaaatatcctgctctacgactcaaaaccaaacaaacattgttatttgttggtgaagggggcacctagaagcatttactgaccgagcagtgactttaacattattttatgtatcaatgtcaccagtttagaggatttcactatattaacaagtcctactgtgaaaataactatagtattactgattatataacaaggtgaaatactatattttgaccattaaactatttttttttaacttgggtgacatttagcaatttaccatttccagcaatctaaatgtttatgtcacagaaatcacatattaaattatctggaaatttatttctcaggaggatcaccaaggcatcagaaaataataataattaataacacaactataacaacttgacgttttataaggacaaagtatacaggttaatcactaatattgtaatttttttaacagccattgaactaaattttgacaattgaaaagaatttaattatgaactcctgatgatttgcctcccacctccaaatagtccacccatcattctttatgaaatatttattgtataggggctgggtgtggtggttcacgcctgtaatcccagcactttgggaggccaaggcaggaggatcacttgaggtcaggagtttgagactagtataagcaacagtgtgagatcctctctctaaaatatatatatataatttattgcataggaagtattttggggggatagtttaattactgttgtacctggttgtacttgatgaatattcacattttttctgctctctaaaatgaaaatttagtatcatttaacaacactaagagacatcatggaagcacaattctttattgccgtattttggaataggggtaaataggatgagagttgtttaaaatacattttactctgtctctcccactgagtgaaactatgcatcctggacagaatacataaagcagatatttgaggaatctaaaaaataaataatagcagatgtagtgggaagaagaccagaatttgttcattttttcctctggtatcttctggcttagactcaaggcagcctgacacctgagagagcaccttgtcatagacacacagctgcagacgccatttagttcagactcaaagagcatgaaagtgacctcttgttagtggcagtggtggcagtgaacgctctcagaggctttaaattctgaaggaagagaactttgatttgaggaaatctggtcccaagatggcagagcaaactttcatgctgtttttctatctccatcctcccatcacttagtgtggatgcagcggcaggaagtaggtggcagagaagggggtaaataaaaccccagctttttggctgcaggactgaaaagaggagctcctaggaaccagtaagtaggaaagagatagcacagagggagaagcttgggaaaggggcccaatggagttgtttacaaatttctgagctctttttacggccacagtcctctggtgaggactgatagtagaatagtatgcttgtttatgtccttatctggttggatgcagcctttattatttatttatttattcagcaaaacatcttgtccttgttggcaagatgctctgtgaaatgtgatggagtctttttctaaggcagagtgacttatgttcaaaggctctctttacatatgggctccttacttagttgctcagcatctcaggcttgccatctagaaaatggatagaattctcactaccgtcaagaagtgttatgaggattaaatgaattaatgtacactaagcaactgaacctaacaaatgtttctttccctgtggcatttggtttttagctttcctatccatttcctaagtatcaggcccttaggtttcatgtttagcactcctttaatctgtcaagtttactaagttgtaggataatttagaagcttcctaagaatcacatgttaaataaaaaaagaacaaaggtcttaaaggaaggagtgctaagataaaacctatggtaacctgctgccctttttcttacttctgaagagttgaggttgtcagaaaactaatatttagatatgggcttatctggttcataatattctaaacaacactgctaccattactattattaccaactaaaactatttaggatgtgtcaggtattgacattctacatatattaatttatttaattcttacaataacatgataaggtgggtaccattattattctaattttacagaatacataacaaaaacatcactttattgccctagtcttgttattcatattattaaaaaaacaactattgtgtactggtcttaaattaactataaaattagttaatatttggttatctctttaggataaaaactctagctaaaatgagccttaatatgggcaatgctttttttcctgctccataaaacagaccaaccctccttgcaagcttaaggctaaaaacccagaatgtaataacaactggaatgttggagatgcatcaaggtttttgcaatgtaaattccttccattaccttagttcaggtcctaagcttctctagtttaaattattacgattgatttctttttatttatttatttattggttttgagacggagtctcgctgtctcccaggctggcgtgcagtggcgcgatctcagctcactgcaacctctgcctcccaggttcaagcgattctcctgcctcagcctcctgagtagctgggactacaggcacctgccaccacacccagctaatttttgtatttttagtagagacggggtttcaccatgttggccaggctggtcttgaactcctgacctcaggtaatccacctgccttggcctgctaaagtgctgagattacaggcatgagctgttgtgcccagcctattacaattgatttcttactgagcataccaatctcttcttcattgactgcatactccaccctcactgcttgaattatttttattatttacatgcctggtttaaaaaataatggctgctcaataaagtaggacctttttctttcttttttttttttttgactgagcacaggggactttagtaataggacgtgacaaggtggagctccctaggcccctcccttttcaggtggtctgtgtggaaattgtgaagaggggagatcctcagtgttgtgaggtctgagtgcagcagggactccccagcagctgggggcctctctcttcctcttatactctcgctggggctggtggtccgggggccttattccttggaagccatgtgggccatgaggtccaccaccctgttgctgtagccaaattcattgtcataccaggaaatgagcttgacaaagtggtcgttgagggtaatgccagccccagcatcaaaggtggaagactgtgtgtcactgttgaagtcggaggagacaatctggtgctcagtgtagcccaggatgcccttgataggatcctctgaagcctgcttcatcatcttcttgatgtcataatatttggcaggttttccagatggcaggtcgggtccacgaccaacaccttggcagtggggacatgggaggccatgccagtgagcttcttgttcagctcagggatgaccttgaccattgccttggcagtgctagtagatgcaggtatgatgttctggagagccctgtggccatcaggccgcagtttcctgcaagggccatccacagttttctgggtggtagtgatgacatggactgtaatcatgagtctttcaacaataccagagttgtcatggatgaccttggccaggggcgctaagcagttggtggtacaggaggcattgctgatgatcttaaggctgttgtcatacttctcataattcactttcatcatgaacatgatggcttcagtagagggggcaaagatcatgacccttttggctcccctctgcaaatgagccccaaccttctccatggcggtgaagatgctggtggactccacaacgtactcagtgccagcatcgccccatttgattttggtgggatcttactcctggaagatggtaatgggatttccattgatgacaagcttcccattctcagccttgatggtgccatggaacttgccatgggtggaatcatactggagcatgtaggccaggtagttgaggtcaatgaaggggtcattgatggcaacaatatccactttaccagagttaaaagcagccctagtgaccaggcacccagtatagccaaattcgttgactctggccttcaccttcaccattgtgtctcagggatgtggcaggcgctgtgctgcacaagaaaatgcggctgtctctaatgggagaagggagccaaaatagggcttattctatgcttctaagaactgaatcctggcctcacttatttctctaatgctgtctcctctgactgaaagtaacaaacagaaagcccttgtccagtcacacaaatacagtcatcattcatgcctttgctgcagaatgtatctgtcactcttaattaagttgtgataataattttattgtttactatttattgaggacttacattgtaccagggtttgttctaagccctttatgtggacctattttatagataaaaaagctgaagtttagagaaatagtttgcccagcatcatacattctgtaagtggggttgctgagatttgaactctcggcattctaatacaagcctgagtttttagccatgatacatattgctacctgtttatttctcacattgaagaatggaaaggatcacactgacactgcaaacctaacatatacatcttgtttccaggaggcaataagataaattgcatggaaggtctgttgggaggaatttggatgttgttactgtcccttaccctgaaggtaattattaggtcttttgagcccagagcttggtaacagttgccagtgttgataagccaaaggtggggtattttcctttttcctctggttaaagatcaattcacttctttcatgttttctttttagctgatgataaaggagaagaataaaaggatgacagatgtgaatacttaatcacgttgcttaatattatggagtgacataaaaatatggtttgctttatctagacagatgtggttttataaaataatcatggtctttttgtttgccatgtagaataattatgcacaaaatgggagtgtacattctggaaaggtcatcttgacttttaaagggtttctttaggcattcatgattgtcactttctgatcagtatgggacaagttgggatacataaaactctattctgtgttaaaggaatatttcaaagattccatgtttaatgaaataaagtattgcctagaaattagagacttgtgattacttgcactgattcattctgaagttttctgaatgctcttttaaaaatctgtagctcttagtttcttatttctttcagatatcaagaaatgcggatttccaatgcacttagcttatgctcaatattaagtgaaataattaatttagcatgtccatgatgatactaaattagtaattcagggtagttaaaattgcagtggatgctgaactgatccaagaaacagtttcaaccttgtgaactggtttggaattagtagtctatcattaaatagtaattaaacatcaaaggcttgaaatggcccattatgtgcaacagaaagtttgtgtgttagaataagacacttgaattaatatatatttcataattttatatagcaattatgtggtgataaacagtataattattttattttttatgagttcattgtctacattttatattttacatagtagttatggagaaattgcctactctgtgatgataaacagaagactttttattatttttaaactcactttctaaaaatataacacaaaattggtttattttattttatttatttattttgagacaaggtctcactctgttgtccaggctgaaatgcaatggctcaatcttggcttgctgcaacctccacctcacaggctcaagtgatcctcccacctcagcctcccaagtagctaggactacagatgcaccactatactcagctaattaatttttttttttttttttttggagagacaaggtctcactgttttgccaaggctggtctcacactcccaggcccaagcgatcctctcatctcggcctcccaaagtgctggaattacaggcatgagccaccatgcccggctaattttcttttaaatccctatacagaatgtaatttgaatatggattttgtttttgtaactcatatttgaaaaatgtctcctttaaaaaaatcatacaaatattgaaagtatttgagattttttaacctaaatcaggaatttgttttaacatctgttatcagtcatctgaagccacaacacttggtttttagagccattccactttatgatgtgaacatgcatgatgcatgcaaggaagagtaacatttcatactatgtgcaaaattgtcaaaccttgtatctttggtatgtgggagattggggaagtgaaaaatgagtctgttttattaggggcagtggtatatcatggtgtatgggtcatcattgtgaatcacagggaaagtggcatagcatttgggattgatccacatgccaccagtaaatcttggcccaaatcaaatcgaaatagcacaggaattaagatagttaacatttggcagggcacggtggctcacgcctgtaatcccagcactttgggaggctgaggtgggcagatcacaaggtcaggagatcgagaccatcctggttaacacggtgaaaccccctctctactaaaaaaaacatacaaaaaattagctgggcatggtggcatgcacctgtagtcccagctacttgggagggtgaggcagaagaattgcttgaacctgggatggggaggttgcagtaattcgagatcgcgccactggactccagcctgggtgacagagcgagactccatctcaaaaaaaaaaaaaaaaaaaaaaaaaagctaacatttatcaatggttaattatgtacctggcacagttctaagtgtttaaagtgtattaaatcattaatcctcacaaaaaccttttaaaataaatactgttattaattagataccagcaggggtgagcattgtatagaggagcaaacaggtatggagtggttgagtagcttgctacacaactagaaagtggcggtgctgaaattgaactcgggcagtttggctacccagtcagcactcctaactattttattaaataaatatctccctcgggactttgattgaggtctaagtcatagaaatggtctgttttcctgaatttttcttcgttaagatgaaagttctaacttcctgccagtaaatgtctaatttatctggaatttgtatcttcaggatatttgagtcttagagtttgtttcattgtcccagtggtcagtctaatgttgagcttaagtcatttatgaattcagcccttttgtttttatgaagatgtagaaaatattctatggctttcttttccttttctttttgtagagacggagtctcgctctgtcgcccaggctggagtgcagtagcgcgatctctgctcactgcaacctccgcttccgggtttcaagcaattctcctgcctcagcctccccagtagctgggactacaggcacttgccgccacacccagctaaagaaaatattctatggctttcctgtgggttgctcctaagcttcctccaagatatttcttctttctcctctttccagaagcacagtcacccatctagcttgggctctctttagcctcctctgtagtaatcctaactctagtctccttacaatttattttctagattaacttaagcaatgttctgatcacaaactttactattgtctctccatttatcattatatacaatccaagtcccttaatgtgatagcccaatgtcttgttgctctggatctacctttcttttcttatcttaaaattcttaatcatcatggaagctaacatttattgagcacttactatataacaagcactgtgcttacttccaaacatacaaagatgaagaatagaacctactttctccctttgtgattatcacagggattatctcacttaatctttgtggaaaccatatgagctatgtaatattattaactccattttaatgaagaggagacaaagtcttgaagagtttatgtaacttattcaaggtcacaagagaaccatgtggtagatctgggattcacaccctcacttttaagccctatacaatactccccatgtcataaattttctaactctaacccatctttagacgtatggggctactcaccactccctttatatccctcacttttttctcttcattatcatgttttatgtcattttattctccttgtatgtaggtctcaatttttttccttatttctgcctattgagtaacaactgccttcaacctgtggatataattgacctctcccaccacagaaccaaagcttcatttattttcttaactcccatagtgctataaccttgtatgctgcttatacagactatatgatgagctttatcgagtgctaaaattttttttaagagtaaacgcttctaattatgtgtcataagtaagttctcagagaagctgattcagactttccaccaaagggttgtgttggtacagaaaacataaacatcaaccacattttagcacaattttcatcattctcttgtggtttgacttttctgatgatgtctaaacttagacataaaaggaaaccccgccttatatggatgacatggaatggaaaagaagctccatggctttcctgtttcactggtgggtttgaccttttccacacgtgcatttgctttgaactcctcctaagttaggtgctacgtgaatacaagttataattaacatgctttctttgggtctccttgaacaaaatgttctctctcatgatatgctatgcatatttactttgaatgaataatagttttgaatttggatttagaaagcagataatgtgactgaaatccatgtttcttctttgcctttaatctagggctgcaggatggggcccaaatgtgaagggaataaaacatgagagaaccttgtttagccacgagataaccagggataagagtttagcttataggctctaatcaaacgtgttatttttcattgaaaactggcgtatggtatcactatgcagctgttaaccagctgtttcctttctactggggttcttgtgtgctctctgctttaaatttatgtgttgcttgggatcccgaaggataaaatagtacttgtaggttcaaggtagtggttggaatggttgtttgcatgtttttagattttttagtttaaagcaacatgtttaaaatgttttcttctaattgctattgtgaatatgcaaatgtttatttaatcatgctcaagtgagagaagatatagaaacaattcataggctaattcaaaccatgtttttccctctcttgtttgccctacactaatctgccaagcctgtatgattgtctcagttctccatttagcaccgaagttagttttgaaccctgaaaaaagagacatttatatacttaattatttacatataataataaatatcgtggtcatgtaatggctacttcagtcattttatttccggaattggttccttccagtgggttcttggtctcgctgacttcaagaatgaagccatggaccctcgcagtgagtgttacagttcttaaagatggtgtgtccggagttcgttccttcagatgttcagatgtgtccagagtttcttccttctggtgggtttgtggtcttgctgacttcaggagtgaagccacagacctttgcagtgagtgttacagctcttaaaggtggcgcatccagacttgttcattcctccgggtgggtcgtgatcttgctgacttcaggagtgaagccacagacctttgcagtgagtgttacagctcttaaagatggcatgtccagggttgtttgtccctcccagtgggttcgtgatctcgctggcttcaagagtgaagctgcagaccttcgcagtgaatgttacagctcataaaggtagtgcagacccaaagagtgaacagcagcatgatttattgcaaagagtgaaagaacaaagcttccacagcgtggaaggggaccccagcgggttgccagggctggctcaggtggccagcttttagtcccttatttggccctgcccacgtcctgctgattcgtccattttacagagcgctgattggtctgtttttacagagtgctgattggtgcgtttacaaacctttagctagacacagagagctgattggtgcatttttacagagtgctgattggttcatttacaatcctttagctagacacagagtgctgattggtgcgtttacaatccttttgctaggcagaaaagttctccaagtctccagctgacccagaagcccaggcagcttcacctctcaatttcatgccttcactggcccgatgacagagtttcaccaacagaagaaaatctttcggtttgtcacagtgtgtatggtctgtggtcagatatgtcaaagaatggtaaacaaaggcctgtagacagtatatcagtgctatggtttgaatgtgtcctccaaagttcatgtgttggaatcttaattctcaatgccataggtttgagaggtgggacttttaagaaatggttaggttataagaccacatctggtctcatgaatggattaatgccattagtgcagcagtgaattagttgtcacaggagtgagttcctgatacatggataaatttggtccccttcttccccctctgtcatgctcttttgccttcctgtcttctgccatgggattacacagcaagagggtcctcacaagatacagccccttgattttggacttcccagcctgagccaaatacattcatgagccaaatacatttctttttttataaattacacagtcttaggtattttgttagagcagcatacaacagactaagacaattggaattcctactaaggattcacatggtatggagtttaaacataatggaatatgtttgtgttatcctttttattattggaaggttgagattttattattacaaggttgagattaggaaaataatacctaacaattataacacttactacacactaagttttctacatgtattaatttatttaaccttcttgataagtactgttaacatctttgttttataggtaaactgagacaaaacatgttaagaaaagtgtacatggttacacaacttgtaataatcagagaaggatttagatgttggtaggttagctctttactctgtactagactgccttgagttgttgcaaggagttaataattaatcagattactaatttcagaagtagtccagtggcatgtgcctctataattcctgtgtttggtatgtttgattaacttcccctaaacttttagaactctttttcatgattgctggggagcaccagtgtgggggcagcaaagcttctatctagaagatcagttaagtcaagataaggaattcacagtaggtgtattaggatatatcagggtgtactagtcaatgtcaaccaaatgcagagtgagttgagctgggattactatatcatgctccaacaattcaaagttttcatggggatctctcttttctgaaaccaagtctaaaactctcatacctctcatgtgaatttatgttaaatttcagagcattcaaagattttctcaccctaatgttcccttgaattaactagatcaaactgctgagctcataggaggggcttctgaaatatgtttgcttgtttgcttttgcttttggatagatggataagtggataattgagagaaagaaaaataaagttcatattaataaaattgtaacttgccatatttcattttgttaccaggaagtaatgacagtctttaaatgacttagtcttcctccaaggcattgtctcctgctaagcctcaataggcaggtagggaagagaagctattgagagagggagtgctctatagatagttttcttttttcttcctgaccacagttagcacagaatatggaatcatttaatctccatgttatctttggtgggggccaggaatataaggaggaacagaagctaaaataacaccaccaccaccaacacagagaagctaaaatgaaattactgagttaatgactgagtcctctataacagcaacttaatatattggctgtgtaggccatgttattaaattgtggttccagtgagtatcttagagcaaataactatagcaaaagtactattaaattcttagcaaaccaataaatccatacctgccagttaagggcaaaagatatctaatttacacatttaagatgtatacatgctacatttggtttcagagcattggtttccttggatttaaagtgcatttgtacattaactagaaaaaattggtagactttaacaataaggtgaaatactcaaacctgggaagaaatcagtaggctttaactataagtttaaagagccaaaacaagccaccaaatgaaaaagtgaaagctcatgtgtgctttacacatagcagacgtgctagaaataattgagtaaatgtagatggacatgaataggtggagaaaaacctatgaattaatggcaccaaaatctcaggttctacttggggaacgaggctctgccgtctggggaggtaaagtgagctagtaaaatgacatgatcaaccattgctaggataagctgtttagtcagaacactagctaaggtctcagctaaggagaatgagtaagtggtaatcatatttgagtaagtggtaatcatatttaaagactcagagatcaacagaagcaaactcctttattatttatttgttattattattggggatctcactctgtcaccccggctggagtgcagtggaatgagtatagcttactgcagtcttgaacccctgggctcaaatgatcttcccacttcagcctctcgagtagggtgtaaaccatcatgtccagtgcaaagtcctttataaggtggcatacttgccttgggtaaagacaaagatgaccagtgttggtgagcagtgttatccagtagatccagatgttttgctgtcaagatcaagaaagtaggtaaggcaaaagaacgggcccagtcagagcagaacacaggggctgcccttgggagaaaagtgggactaaacagcatttgggatcagaaaatcattttaatatgatgattcagggtattttactagcccactttcgaattctcttcacctaatcattataaagactcctatggctggtgattcagagagctcacaaagtctaaattgcatgtacaaaaggataaatgtaaaattttgcacttagcttaagaaacaagtggatgatgggtagggagaacaagctcagtcacactttgcaggaaaacaaaacaaaacaaaacattgcattaggaattttaaaatttaatcttaactgccacaagtcaactgtgtgacttttggcacaagatcttttaaaaccttaatttccttatctgagaaagaggatgttggaagaagatcgtctctgaggttcttcctggatttaattttgtagttctatggcgtcgagttttcttttaagtaccaattcatatgaagcaatgttgtgacatgtgatgccaaaaatctaattcattaggagaaatacagagactagattatcctactgtattcagtgtagtcgcttcatttggctggacaatcaagttatggttgccatatattttgaaggatattaaaaaaattataggagatctagaggaagttgactgaggtgtttattattgtagaaacaattgtatagaagaaaacatgagatgaactagggttcattagcccaggccagagaagaagggggcactcagtaactttcttccagtatcccctctcatagctctagatggaaggctgtaggaagattttccctaaaggctacataaaaagaaataaaaagacaaaccttcaaataattgcagtgttccagtagtaaactggattgctttgtgatgaaacgatttccctcacaaggatgatgttcaggcaaaagttgaaagaccatctctgcagggaaagctggatttgatgatcttgagggtcccaggcactcacaggtgcttccatcttatgatttgctcagtcttgacattagttttgaaattacaataaaaacaaatttatgtgctaatatcagaagtgataaatttttatggcaaactattttctgattaatcagaaataaaatattataattgtcaaaactcagacaatttcatttagttctatataaagaactattgaaaacagcaacatgatctggaggtttttacagttcctcttgctccttggcgtctttatccttcaagagcatttctctgagtgtatttctttcacatctaattctgtcttggtgcctgcttcttggagaatctgagttgacctagtaataaacacacaataaatattagcaattttctcttactctttcctctgtgactcaaaagcaatttgttttcttcctgtgaatagtttgtttactgttggtggatatagaattaaagtgagttagaattttatgttgtttttcctaacggaaccatggaaacgttcttgctgtttgatagttacaaaatgcctcctgattttaggcggatagtaacaatttagaattgaattgtaaacagcatttgggaccagaaaatcattttaatatgatgattcagggtattttactagtaaaaatacttaatatcacttagtatttagacttcacatctaactggactagatgactatttatgtgtagacaggacttagaggcggaacagcaggaggaaatgtagaaagtcaaacacctggctagggaaaagtccttacgctgtctggatttggtgtcagcctccgctctgtctccaccactagcatttccagccaatgcatccctgattactcaaagccaagcatttcctgcagagtagcaggagggataggaaacagcatgtgcttcctggtctgggaggtggcacaggactgcggggcagccagtaatagcaaacacctaaagcgggaaaggatttggtgaccctgtgaacagaactttgcttttcagcagaatgacacaatcatctgtagcattttagtctggatttaagtcataactactgagaacacactcactgtagaatctttgcttttggggcaccagtgtaataaggtagacaggactgatactgacttactcaggggagagaaacaaagatacacccagctcttccggagcatggggtgcccttggtggaaataagcaaacattatttttttgccctggggtcagttaaggtcattcaggaatcacttcattgagaaggacagtcttgaagagagtccaagagaaaaagcataaagttatgctttgagtggagggaagggtataatcattccagttaaagggaattgctgtcgatcacagctctgaagcagagagaatgatttgttaaccagggccgtgaacttaggtttacctttgaagttcttaaacactgtataaagctgcatattttaagaagtagagtgagccttaaatatttaaattatttaaatgtgtatctctcttgtagggcatgggaagaggaccatagtttctgtggcctccctaagatggcctgccacctctcctgatgctggtgacttcttgtgatggtggggcaatattaagtgtttgaaaaaggaagaagttcttattcccaagtgagagaccatataaacatagaaattaaagacaagggatttggatgaggtgtggatatgaattacagttttatttcttgctagtcatgtcaccctgggagagttacttcatctttctgagcttcagtttccttatgtaaaggaatggtgacaatattagctcctatcacaaaggatttttgtgagaattcagtgagatgtgccatgtacaatgtttagcacacagtgccagaaatattttatgggagcacagattcaaaaatgactaattagagcagttactgaggcgtctcagtgcaacagctgtgtttattattgaattgcctgcaaaaatgggcacacatggctttttaaaattttttattaaaagttagtaatttatgatggctttattaaaatacatgactagtgtaactggcttttatcacatagaacagtttatgttttcattagtgagacgaaaagaaaaagatttcctgcatcctgaattagagctatcatctgttaaaaatatttatgactaagaaacaaaagatacttgtttttacaagataggagctcaatatataattacaaaatgaatagattcacctatttattaaatacatatttgttttaaataatgataagtgctaatgggggatatgatagggattgggctgtgtgtgtttgtagatattgtagtgttctgaaatttagattgggcactagtcttaatgtctaaattccaaaattacttgaaaattgcaacttctattaagtgtgctcaacctaaaagtttccagaaggtttacgataacattcaagtttaaattcaacataattgcgaaaagttgtattttgtttattttcagagtttatgaactttttctgatgttttcctaatatatgaaaatgaaattgggaaaaaaagttagtttcagtaattggacctacatccttcagcgtggatttgtttccccgtttggctaatgtttcattgacctctacaaggctggcatttctagaataccaaccgagtaaattttagactctccacagttgatttttgttgaagctatcagaaaccatcaagaactcatttgataattataagtttttgtgtttgtatagtagttaatttgcaatcatgtgctgttttgttgaatgtttgaagttggcttgctattgatgtccttttctaggatgcattttccacatagaaaagaatacatgcctgagttctcaggtttatttgttcatttaaaaataatttatcaagtgcctatcatgtgctacatggttctagtattaaattgaaccccatgccactgtgggtattctatcctttttaactcaaaagtcagaaatttgatatagttcaacttattcaaaaacaagtcccctttaaagagctttcaatctaatataaggttttaggtgtataaaaaaagaatgcctctaaaagtttttatacttcattaaaaattttgtggccatggaattctaaaattctgtagatcagaaatatttctatataatgaaatatacaatgaaaatatttcagtataatgaagttatttccctgatgcaaggtctcatttagaagagtttgttttctgcatgaagcatccaaagtaataaatgatttcttcatccttgcgccgtgccgtatcatcaagaattacttatttgtccattttgttgtgatttttaaagctaatttagaatcaaaactgaagtgagaagttgaacagtagcccagttttgttcctgcttggaagaagtaattaatctttaacttcccgtatttctacctactctctttcaaaagcacaaataattttccttaccagaaacctcctaaatttcatagcattcacagtatacactgacatgatgtaggagaggtgacatgttatgtgcttgaattcagagttttttcccccgttctttttgatttaatgcctgaaaagagtagtggcatatggactctgttcttattcaaagcccaattatggtatgattcctggcaaaaacgttcaccattatacaagtccacaaagggctttgaattattgaccctactcagtaaacaagagagctccttgttgttggtcccactggggatgggggagcacaggcaaggtagtggaaggcataaaaaaggaaagcaaggagagatgaatatgcaaaatgctgttattttaaaccctcttgttttagtttacattcaaggaattgtatgtaatggagagggcacagaattaaaaactaaaatgatgggattccaagcaggctaaacttaaagtaccttcctaacgacaagcctacctgcctctgtacccattgtttccccctcccattttggttggaggtgacactccttgccattgggccaatcctcttaccaacatcagaagcccacttctttcttatcatgtttttatcatcctccttctcttctatatcttctccttctctctttctactggattttcctcatcagcatttaaacatatggaagtcttttaatttataaacatctctttatcctattttcccctcctgttaccaccctaatcctttccatctttacctgtgcataagaagtagcacagcaaggcaacacttgtctttactcaacagctccatttccttagctctcattcattaattaatcttcctctgaaagggctaaaccaaagttatcaatcatctccctgaagctaagttcgacaaacattaataagtttcttatcacttaccctcttatcaaagcacaacaaagctgaccatgccactccagtagatcctccactgacttggtttccatgatactagatccgtttggattgtctactgcctcttcagttgctccttctccttcttcatttaccagccagtgctcctcatctgatctgaaacgctggacttcttcaagcttcaatcttcggctctcttttcttctccttagaccaagatttctcaatagcttttgggtcttaaagaatccttgacaaaaaattattgctgaacttccagtatatcagcatgatcagtaagttgcagacataataaactaaaaatactattaatactcttttggagatagaatgatagttttctatggatatgtttattttggctaatattatcagcccactcattttgtgtggttctcctcccactaaggatatcaacttgaatgtaagtcaatagtatgagtagcgcaaactttagtttttctttttttttttaaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcctgggtgacagagcaagagtccatctaaaaaaaaaaaaaaaacaaaaaatgaccaaaaacccccccaaacccatacattctactataaaaaatgcaaacacggtatggtatgtggtacatggtgaatggcaagagtgctttttccctatttacaactaaagatgacttgttagctaacctttcttgaaaaaagaaaggcaataagcttagcttgtcttttaaaaatttaattcctttattttcaataattcttaaaacccatgggttaacatagtaaatttctgttaataaataactggcttaagccaaaataatttttaaattgtatttacttagaagcattcaaaatgtcaacaacatggctgcaactgtttttttttttttacaattatagagttgtattcagttatcaaaacaacaattattttgtataaactgcatcagagacaactgaagatgaaagaactaccatctccacatataactaatttgtgcagtgcaccagaaagaacctgtttaaatttccatgccaatttgcaacccccatactgtgccaggtaaggttagtggctattgaaaatactacctggacagggctatctaaagacacattggatagtgtgttaactatataaaaaaagacactgtacaatttaaaaacaaattttatacagacttacatttcaatttgtttctttaaaaagtagtcagttgtgtacaggggggttaaatgcttttaagacaagaaaaacactgcactagaaccaacttattaacattgtcattatctcctcctcctcctccttctcctcttcctcctcctccttcttccttcttcttctccctcttcttcatcttcatcttcttcatctttttttcatcttcctcctcttccttcttgttcttactccctttttttttggctacatcagtctttcctttagcttactgtgcagcaatattctttgggtatttttccttcagccttgcatccttctttttataaggctgcctgtcatctgcagcagtgtcattccatgtctctcccagtttctttgcaacaatggataggctgggatgttctctttcgatttttgggtgatactcagaaaagaatgaggccaaaggaggcctcttgggtgcattggcatctttgaacttcttttttctttcttctttaggagggacatgggtttcatttctcttttgtaacgagtattgtctacctttgccatgtcttcaaatttttctttcttcttggcagacatggtcttccacctatctgggcacttcttagaaaactctgagaaattgaccgaacatttgggtgcttcttcttctgctcctcccagcaagtttacacaaagaatgctgtgaagatattttgcctcttggcttcttaggctctcctttgcccaagtttagttatttttcctcagcaaggcacagaattatccagaatcacccagtgcccatctggttctcacttgccctggcattgtctttatgcagctcaatgaactacaactgagatttacttttttaaaggtaaacttgatagatttaattaaataaaatttgtcagttgaatttaattaatattatttacaacacaaagatttgttgggaatgctgaatagtaaacctcttaaaataataagtcaaagcagtggaaataaaaatacagcttaggacatatataaaagtcaaagtcttacagattgcttgttggaatgtaaaattgtgttgtcactttggaaaacagttctgcaatttctcaaaaattaaatataggttttcatgtgccccaacaatttcaccactaggtatatactcaagagagcaaaaacatacgtttacacaaaagaattgtacatgatgtttatagcagcagtatttataatagccaaaaattacaaatctaattgtttatcaactaataaatgaataaataaaatgtgatatatccataaaaaaaaaagtcaaagtctttagtataaagctgtaacaaatcattttctttgtgagtgacatgattaggctcaaatatagacctagaagttacaaaattgttatgcagatgtgtgttggttttccaatctcttttataggcctaaatatttttaaaagtattatttgaaccaaaaggaaagaatgaaatttacacatgtaatttcaaacttggtttttgctgcaaaaatactcaattctaggtcaaatatatgaagtaagcattcaactacttcattttcaactatgatcagacaatttctgtccttgtttttggtgtttcttaaataagaaaatgttgctcataaatcaaaaaagttgaaaaccacagcaaaatattcactgcttcactgtaaatggcaggatactctgtcttcacagaaacccagaactcatataggggcagaactcttattgtcatttgtaagaataatcagacttcatctcaaagttcttcctcttctctgaaaatcaagttctcatgtgaggagaaaatctagagaaagcatccctcaccaagtcagacacttggattgaagggaaaagtacactcagtgttgctctgcagttctctggatggttttcaatatgctcatatcctccttcaatttcaagcccaagcagcagttgaaacatttcacaatttccttctgtgacttgttttttcctaaagattcaatttctttaaattcaagaatcctgtcatttgaaacaaaaaaaaagtttctgggccatacaaagacttgttcatctggataaggtgatggaaaatggctgctaaatagcctagtttctgcagccattctttatcttgaaaccctctagcaaaatctgacctactaatttcttgaaagtgctacctttcggttcaaacaccctgttgagaactcttcctctgctaactcactggatgtagaataaggtttgttaggtggcctccaatattctcataccatcttcaagccatcttcagtgaactggtctgtgtttaatagtaatcatccttgtagcattactcagatttttttttttcattttgtatttaagagttttcaacaccagtagctctctggaaataagtcagtgtcttgtgatgtcagtgtgaaggtgaattttcttggggcaccatcaacgcagatgccagtgccattcttgcaaaatagactttctgttttcagatataaagatgaagagaaaaagtatcttgtcctttacttgttttgggcaacatcctgcagtagaaaaaaaatgttcttaaatttcaacattatttataaatcttacaagtgctacagcatgatgtttattggtgaaatttgtttattcatcaaaatggacaaagaagctgtaatttttcaatgtattataaaaataccttcagcatcatgtggcatgccatcagtatgtcagcttattatgctgattgagagcgtgactttttcagttgcttgtatggaatctcattctagcattttcctaattatgaccttacctgctatcattattaagttctcaccaactatgcaacttttccttttctaggctacactttgtgctttggataactccaaaataacttgttttcagagccttttccttgagtgtgactgttttttagaacaaaatatttattttgtttgtttgagattcaaattattgtttaaaataatcagtatctttatttgttaaatggctgtaatttgtagttaaatgtcttttcaattttgctagttattgctgcatttttagttgtttggtattgactgtgcacaatagaatagatcaacttggatgtaaaactcattgttaagtagctttcattgtaaaggtgaactttcttttggattctctgcactgggggagtgaattgactcaaaagattttatttccttatccaaccttatcaaaactgtccagaagcctaagcctagaatctttcttttctatctcatacttcatcttcagaaatcatcaacccaatgttcagatatatttgtgaaacacaaatgcagataaaatataaaacagaaaggtacagcagggcacagtggctcacgcctgtaatcccagcactttgggaggccaaggagggcggatcacaaggtcaggaaattgagaccagcctggccaacatggtgaaacccgtctctactgaaaatacaaaaattagctgggtgtggtggcacacacctgtaatcccagctactccggaggctgaggcaggagaattgcttgaacccgggaggggacattgcagtgagctgagatcatgccattgcactccagcatgggcgccagggccatactccacctcaaaaaaatgagacaaaacaaaacataacaacaacaaaaaacaaaacagaaaggcacaatacctgagaaaatctcaagaaatgcaaaacctacaatacagtctatttttaacttaccgaattcacattcagcacttattacaacaacaagcagcagggatcagatgagtcttggtatgtataagtatcttctttagggtgaaaaggtcccactgattgtctgttacacctgtagagcttatttttttccttgtcagtaggttgtatataaagggaggtgggaaaggtaacttggagggagaaggtggacatcattttcctgccttcctcacctttgtgcagcataacactcaacagatatccaaggcctccctcacctggcatcaatatctgagaatggatgtatctaaataaatattgtcctatgtacattaggacaaaatctgatgtttaatatctctgcaatcagtatttcacatggaagctctcgagacatttagcagcccactaggattctgtagaacttctgttgagaaaacttgttgagacaatcttacctacactcatggcttcagttatctaatgctttcaaatttatgtctcctgttggttctggatttaaaattgctgactcgccatctcctcttgaacatttcataggcacatcaaactcagaatgcctaaacttaaattctcaattgtgtctctactccctccccaaccatgcaaaaaagaaaattgtgagccacttccagtgttgttcccctcagcaaatggcaccaatgtccactaactgcacaccccagcaacctggacatcattctttactcatttcccttaactgtacctcctattccatgtttaatcagtctctaattcctgttgattctgtttactaaatgtcacaacattgaatcttattctatatccccaccactctgaatcaaactattcccttttttagggctgaatttccagaagagtctcttaactggtctttgttatctactatgaaaccagtccaagtcattctctactttgttgccaaatcttatcacgtttctccctgcttaaaacttctcaataactaccagcacattgctcttaagatgaagaccaaaatccttaataggacatacagtgatgtgcgtgatcatcccctgctaacctcttctctgccttctcccttcccttattgtattccatccatgaagacttatcaatcccctcttttaagaggctccctcacgctgtcctccctctgtttatacacctcccactcctttcatctcactcttactcatccttcagatctgagtttaaatgtcatttcctcagagaagcaagaagttccttagtactgtgtatttctgcctaatttcacttaccacaattctaattgcacagtttgttggttattatctatccctgaagcaactctgattgctcttgaaaggcagggagtgcatttgctgtgtttaccacctatctccagcattaacacacaataaaaacaattggtgggacaaatgagtaaatgaattattaaattcactaatttgcttctttcatgctattgctctcaagtttaggaataaaattactatactcattacataaaagaaatatgaatttctaattttagggttttttattagttgaactttttactataagcaaaattgcttagcatttgaaatacctttttaaaaaatgttgcctagtctaccatctcatgtatgttgtaagttttatgtgattaaataagttttgatatgcagcaaaataacaacatgaaattgtaaattatactaatagtctgtgacttaattagcatgaaaaatcttcccatttatttataagaccaaataaaaatattaacttgagattagcactgcagctgttgaatatttcagtgctattaaatattggaggacataatttaaaaatgtacaaagatcatacacagatcgttttatagttttatttttcttactattatttagaaaaagacattttgaaatcagtgtttcccacaaagaaaaatacttaaatatgtaattttaatacatgcatatgccaaaattaatatttatttatttttgtttggatataagccaacatagacatgaatgtagctcttttctcctgagatagaagaacacactattgaaattcaatcagagcatccagatgtaaatgagctgttcatctatagcccacaggatgttcactttggcttcaatccttccagactggatccataccaagactttctattattactattaattagcagttctggcaaaattaaggaatattgttatgtcagcttgaaatcctttagactgactagtgatctcaaaaaaagttaagacttgatcgataattattccaagcatgatgattaaaaattaaattcctgatgtgatccatgattttttttccctctctcactctattttagaaaaacagggtaggtatttattagagaggaatctaaaatcagaggtagaaaagggcatggattttaaggtcttctctgtcttcatttagtcttccctttctttccacagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggaccagaaaatcttccacattatcctgtgttcaagtattaggattgtgcaatacatttcttagaagaattctgcctactactcatgcaaacaccaaacaggacaaatacaaaggcgaccacatctagacatgtcatattcaaactgctgaaaactaacaacaaaaaacaaatcttagaaggaaaagaaacctcgcatggggaaacaatgatctaaatgatagccaactttgcaggccagaagacagtgaaatgatacctttgcagtactgaatgaaagacaaagtcaacatagaattctatgtccaataaaaatatcctaaaaaagaaggcaaaataaaaacatttctagtaggcaaaagctgagagcactagtctttggtagatttgtactacacaaaatgccataaggaggttttcaggctgaagaaaaaaataccagttgcaacctaaatgaagcatgaagagtactagaaacagcgaagattaaagactattttaacatctttatttttaatacatatgtacctataaattttaacttcttcaaaaaattgactttttaagatataaataataacaatgtattgagctgcagcatatgtagaagtaaaatgtgggaaaataacagcacaaggaccagaagcatagatacatagaattatatatttaccaggttcttacattgtttgtgaagtaatataatattattttaatgtagattgggataacttaaaggtatatatctttaagatatcatatattctatatatcatatatatctttaagatatcatatattctatactgagcaatctataaaaaacaaagaagcatatctaaaaattcaatggatgagattaaattaaatactaaaaactactctattaacccaaaataagacaagaaaaaagggatgaaatgagagacaaattttgcaaatagaaaatcaatggtaggttataacccaatcatattaataattacactgaatataaatgaactaagcgctcaccccaaaaaaagtgattgtcagataggaaaaaagaaaaacctatctatatgctctttataagaaacatatttaagacagggtgcagtggctcgcgcctgtaatcccagcactttgggaggctgaggcaggcagatcacgaggtcaggagtttgagaccagcctggccaacatagtgaaaccacatctctatgaaaaatacaaaaattagccaggcatggtggtgcacgcctgtggtcccagctacttgggaggctgaggcagaagaatcacttgaacccaggaggcagaggttgcagtgaaccaagatcatgccactgccctccaatctgggcgacacagcgagactccatcttggggaaaaaaaaaaaaaaaagaaatgtatttaaataaagtgacacagtcagatcgaaagcaataggttggggaaaaaaaaccatgaaaaaatgaagtataagaaagctggtgtggttatataaatattagtcaaaggagatgtcaagacaaagattattaccagagatagagaactatatgcatgatgataaatggattgattcatcaagaaaacataacaatcttaactgtgcacctaatgacagagcataaaacaagaggtgatagataggacaaaaggagaaataggcaaattctcatttagttagtgtgatggtttggtttatatgtcaacttggctaagctacagtgcccagttatttaatcaaacaccaatttaggtgttgctttgaagatatgttgtccatgtggtgagatctacaatcagttgactgaaagtaaaggatattacttgatgatgtgggtgtgggttcacctaatcagttgaaaaccctagagtaaaaccaggtttcctggaacagaagatattctgcctcaagattgaagcactggctgggcgccgtggctcacgcctgtaatcccagtactttgggaggccgaggcgggctgatcacgaggtcaggagatcgagaccatcctggctaacatggtgaaaccccgtctctactaaaaatacaaaaaaattagccgggcgtagtggcgggtgcctgtagtcccagctactcgggaggctgaggcaggagaatggcgtgaaccccggggggcggagcttgcagtgagccgagatcgcaccactgcactccagcctgggcgacagagcgagactccgtctcaaaaagaaaaaaaaaaagattgaagcactaacacctacctgagtttccagcctgatggcctatcctattgatttcagactcgacagctcctaaaatcacatgagccaattcctttaaataattgtcttaatacatagatatgtatatcttctattgtgtctgtttctttggagaaccctgacttacatagtgctgttaacatcgctttgtctaagtagacaatataatcagtaaatatagaaaagatttgaacagcattattaaccaagttgatctaattaacaaatgcagatataaattatttcaagtactcatggaacattcataaagatcaacatgtgctgcatcaaaaaacacatctcaacaaatatcaaagattgaagtgatacatagtatattttgtgaccacaacagtattaaagtggaaattagtaataaatgtaagtagaaaatccccaacatttagaaattcagcaatatccttttaaataacccatgtgtcaaatgagaaattatgttggggattagaagattgtttgaactgattgataatagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttcacagtccagaggcacaggctcactaaaacattgagtgctcatcacagtactaaagaaatctaccctgacccacactgtcccaccacatcactaaaggcctatttactgcaattccttttacccagtccatgttcacctttcaacaaagaaattataaagcatacttagaggcaaaatgtgcagtttgaaaaaagtaagcatcagacccagagttggatatagcaggatgttgcagttaccagattaggaattttaaaaaattatgattgatgtgttaaggactctactggacaaaatagagaacatgtaagaatggatgcatgatgtaagcagagtgatggaaattctaagacagaataaaaaagaaatactaaaaaaagaaatgctagagataaataaccctgtaacagaaatgaagaatgactttggtgagctcattagtggactggagatagccgagaaaaaaaactgtgagcttgaggatatgtcagtagaaactttcaaaactgaaaagcaaagagtaaaataccaaaaacaatgaaatggaatatctaagaaatgtgataaaactacaaaaggtgtgaatacatgtaacggaaatatcaagaggagaaagagcaaacagaagcaataattgaagcaataaggacacagttttccccaaattcctgacagatatcaaaccgcagatcccggaagcagagagaataccaagcaggataaatgcaaaaaacaaacaaacaaacaaaaaatacccaaaccaaaaaaaagcctatacctaggcatatcatattcaaattacagaaatcaaagacaaattcttgaaagaagtcataggaaaaaaataccttatctttagagaatcaaaagtaagaattacatccaattttctccaggaatgcatgcaagcatgaagagagtagagtaaattatttatggtgtgtattagttcatttcatgctgctgataaagacacacccaagactgggtaatttataaagaaaaataggtttaattgactcacattctatgtggctagggaggcctcacagtgatggtgggaggcaaaagtcatgtcttacatgcagcagagaagagaaaatgagagccaagtgaaagggtttccccttataaaaccatcagatcttgtgagacttactcactaccatgagaacagtatggggaaaactgtgtccatgattcagttacctcctatagggtccctcccatgacacatggggaattatgacagctacaattgaagatatgagatttgggtggggacacagccaaatcatataattctgcccctggctcatcccaaatctcatgttctcacatttcaaaaccaatcatgcctcctcaatggtcccctaaagtcttaactcatttcagcattaactcaaaagtctcatctgacacaaggcaagtcccttctgcctatgagcctgtaaaatcaaaagtaagttcgttacttcctagatacaatgagggtacaggcattagatagatacacccattccaaatagaagaaataggccaaaatgaaggggccaaaggccccatgcaagtctgaaatccaacaggacagtcaaattttaaagctccaaaatgatctcctttgacttcatgtctcacatccaggtcagactgatgcaagatgtgggttcccatggtctttggaagctctgcccccatagctctacagggtacaggctccctcccagctgctttcacaggttggtgttgagtgtctgtggcttctccaggcacatggtgcaagctgtcagtggatctaccattctggggtctggaggacagtggccctcttctcacagcttccttaagcagtgccccactggggactctgtgggggcttcaaccccacattttccttctgcacttccctagcagaggttcttcatgagggatcatccctgcagggaacttcttcctggacatccaggagtttccatacatcctctaaaatctaaccggaggttcccaaacctcaattcttgacttctgtgcacccgcaggctcaacaccatgtggaagctgccagggcttggggctttcaccctctgaagccacgacctgaaccataccttgaccccttttaaccacggctggaatggctgggacacagggcaccaagtccctaggatgtacacagaagaggggccctgggctccacccgcaaaaccattttttcctcctaagactctagacctatgatgggagggtctgctgcaaaggtctctgacatgccctggagacattttccctattgtcttggtgattaacatttgactcattattacttatgtgaatttttgcagctggcttgaatttctcctcagaaaatgggattttctttcctattgcattgtcagtcctccaaactattccaacttctgtctgttacccaattccaaggtcacttctgcatttttgggtatcttttcaggagcatcccactctactggtaccaatttgctgtattagtctgttctcatgctgctgataaagacatacccaagactgggcaatttataaaagaaagaggtttaatgaacttacagttccatgtgcctggggaagcctcacaatcatggtggaaggcaaggaggagcaagtcacctcttacatggatggcagtaggcaaaagagagagcttgtgcagggaaactccccttataatatggtcagatcttgtgagacttattcactattatgggaacagcacaggaaagacctgcccccattattcaattacctcccaccatatccctcccacaacatatggaattcaagatgagatttgggttgagacacagccaaactatatcagtgcattaaggattgtcatgtctttatggggtattgacccttttatcattttgttatgtccctctttatccctgataactttccttgttccgaaatttgctttgtatggaattacatagctactcctgctttcttttgattggtgttagcataattatcttcactcgttttcttttaatctatatgtgtctttatatttaagatgagttttttgtagacaacaatagtttggccttcttttttgatccactttgatatatatattttaatcagtgtatttagaccattgagttttaaaatgattgtcaatggatctggactcatatctaccatatttgttaatgttttctattcatttaccttgttcttattttgtcttcttttctgtttctgccttttgtggttttaagtgagcattttatatgatttcattttctctcctttcttagcataacacttgtacttctttttgtactttttaaagtgattctcttagtttgtaatatacatttacaactaatccaagtccaatttcaaataacactttaccacttcatattattaccagtactttgtaataaaatattccaaacttctctctcccataccttatattattgttgtcatttattttacttatacataagcatacataagtatcataagcttaaatatatctatatctatacatatgtacccacataagcatacataataaaatatatagattttttaagcaaactactatgttagatcaattaagaataagaaaaaataaaagtttgcattttacttccacttatttcttcttgatgctgtttttctcttttcatagatgagagtttctgaactatatcatcttcttctctctgaagaacttctcttaatgtttttgcaaggcactcctagcaacaaatgcactccatttttgtttgctgagaaagtcttgatttctctttcacattttcttttcttttaattcttcacttttgaaagataatttcacaaggtacagaattataggtggtggtggggtttctcttaacatcatgatatgatttggttgtgtccccacccaaatcttatcttgaattgtagctccatgagcggggctctcatgaagaatctatgctagggcagtgaggaagggaaatgtggggttgaagcccccacacagagttcctcctggggcaccacctagtgtagctgtgagaagagggccaccgtccagaccccagaatggtagatccaccaacggcttgcaccatgtgtctggaaaagccacagacattcaacaccagaccatgaaagcagctgggagggaggctgtaccctgcaaagccacaggggcagagctgcccaagaccatgggaacccacctcttgcatcaatgtgacctagatatgagccatggagtcaaaggagatcattttggagctctaagatttgaccaccccgctggattttggacctgcatggggcctgtagcccctttgttttagcccatttctcccatttggaatggctgtatttacccaatgcttatacctccattgtatctaaaaagtaactaacatgcttttgattttacaggctcataggcagaagggacttgccttgtctcagatgagacattgcactgtggacttctgagttaatactgaagtgagttaagactttgggggactgttgggaaggcattactggttttcaaatgtgaggacatgagatttgggaggggccaagggtggaatgatatggtttggctctgtgtcgccacccaaatctcatcttgaattcccacatgttgtgagagggacccagtgggaggtaattgaatcatgggggcaggtcttccccatgctgttctcgtgatagtgaataagtctcacaagatctgatgatattataaggggagtttccctgcacaagctttctctttttgcctgctgccatccatgtaagatgtgacttgctcctccttgccttctaccatgattgtgaggcttcctcagccgtgtggaactgtaagtccattaaacctctttcttctgtaaattgcccagtctcaggtctgtctttatcagtagtgttagagcagtctaatacgtgcacataaaaacagagtgtcaaaatatgtaagcaaaaactgatacaagtgcaaggagaaatagttaaatccagtattattattggagattttaacacacccctctattagaaatggacaggtccagtaggcaagaagatcagtaacaacagagttgaactcaacaacaccatcaatcaactggttataatggatatctattgactacttcatctaacaacagcagaatacacattcttccaagcttacatggaacattcaccagtatagaacatattctgggccaaaaaacacataccttaacaaatttgaaggaataggaatcatacaatcaatgtcttctctcagactgcaataaaattaaactagaaatcaaaaacaggtagttggaaaatccccacatacttagagattaaacaacatacttctaagtaacacataggtcaaagaagaaatctcaagataaaattttaaatactttgaactaaatgaaaatgaaaacacaacttatgaaaacttgtgggatgcagcaaacatctcacaagtttttaaaatgcgtaaagggaaatatacacagtagtacttcctcatttgcagttttactttttgtggtttcagttatctgtggtcaactacagtctgaaaatattaagtgaaaaattccaaaaataaacaattcttaagttttaaattgaatactgttctgagtagcatgataaaatctcttgccttcccacttcatcccctatgagatgtaaatcctcctttgttcaccttatatacattcactacctggccattagtcatttagtagcagtcttttttttttttgagacagggtctcactctgtcacacaggctggagtgcagtggcactgtcttggcttactgcaacctctacctcctgtgttcaagtaattctcctgcctcagctctgcccccctccccccagccccccaccgtccctgagtagctgggattacaggcaggccaccatgcctggctaactttcgtattttttggcagaggcggggtttcaccatgtgagccaggctggtctcgaatttctggcctcaagtgatctgcctacctcagcctcctggagtgttgggaatacaggcgtgagcagtcttggttattagattgactattgtgatatgaccgtgcttgtgttcaagtaacccttattttacttaatggctccaaagcacaaaagtagaaatgctggcaattcagatatgaaggaagccataaagtacttcctttaagtgaaaaggtgaacattcttgacttaataagaaaagaaaaaaattatatgctgaacttgctaacatctacggtaaaaatgaatcttctatccacgatattgtgaagaaggataaaaaaattcatgctagttttgttgtcacacctcatgctgcaaaagtatggccactgtaagtgcctagttaagatgaaaaaagcgttacattttgtggctggaagacagaaatagaaacatattctgatttacagcatttaggctgggtactatccaaggtttcaggcatccactggaagtcttggaacatagcgcctgtggataaggggaaactactgtagtattgaatgcatatattaggaaagcagaaagatctaaaatcaatcatgcaagcttttaccatagaaaactagagaaagggcaaattaatccaaagtaagcacaagaaacaataaatattagagtagaaattaaagaaattgaaataggaaatcaatagggaaaatttttgaaaccaaaagctgggtctttgaaaagataacaaaactgataagcttctagccaggctaggaaaaagaagggcacaaattactacttttggaaggaggagatttcacttcagagcccatggacattggaaggataataaaggaatactatgaataattctgtgcccacaaatttgataacctaggggaaatagatgaatttcttgaaaaataaaatctgataaaactcacacaagaagaaatagacaatccagataggcctagatctattaaaggaatggaattaataattaataaccttccaaaacagaaaccatgagaccctgatcagttcactagtaaattctaccaaatacttaaggaacaaattatatcaattctctacagtcttttctaaaatatagaggcatatggaatatttactaactcattctatgaggccagcttcaccataatgtcaaaatcagacaaaaacattatgagaaaagatcaatatttcttatgaatatagacacaaaagtcctcaacaaaatattagcagactgaatcaagcaatgtataaaaataattatattccatgactaagtgggatttatcccaggtatgcaaggttggctcaaatttgaaaatcaattactgcaatccatcacatctacagactaaggaagaaaaatgacatggttatatcaagagatgcagaaaaagcatttgtcaaaatacaacacctatttgtaataaaaactcagctagaattttagaggggaactccctcatcctgataaagaacatctacaaaacccctacaactaacataagacttaatggcaagaaactaaaagcttttctactcagatcaggaacaagacaaggatgttccttctcaccacttcttacattttactggaaatcctagctaacacaataagacatgaaaaggaaataaaagatatattgatcgagaagaaataaataaaacagtctttgttcatggataatatgattgtcgaggtaaaaaatctgaagaaatcaacaaaacaattcctggaactgatatgtgattatagcaagattgcaggatacaaggttaatgtacaaaatttaatgtcttttccatatgccagaaatgaaaaagtggaatttgaaattaaagacaaaaatcctttcagattagtgcatccccaaaatgaaatagttaagtacacatccaacaaaatatgtacaagatctatatgaaaaaaaactacataactctgatggaaaaaaaaatcaaggaactaaataaatggagagaaggccaggtgtgatgtctcacatctgtaatcccagcactttgggaggctgaggcaggtgcatcacatgatgtcaggagttcaaggccaacatgaccaacatggcgaaaccccgtctctactgaaaatacaaaaattagctgggcatggtggtgtgcacctgtaatccaagctactcgggaggctgagacacgagaatagcttgaacccgggaggtggaggttgcagtgagtcgagatcgcaccattgcactccagcctgggtgacagagcgagactccatcaaaaaaaaaaaaaaaagagataaattaagagatatttcatgtccatgcaaggaagagtcaatattgttaagatgtcatttcctcccacattgatctacagattcaatgaaattccaattaaaatcctgacaagttattttgcaggtatcaacaaacagattccaaagtttctgtggagaggcaaataacctgaaatagacaacaaaatattgagtgaagttggagtactgacattattcaactaggttacaaatgaaatgggaaaacagtttcatagttggctttgttctatagtttacattagggttaactctaagtgttgtacattctgtgggttttggaaaatgcataatatgctgttttggtgaaaccaaaagcagtaagtgagcaatatatgccttagcaatctatctttattaattcacatatttagagctgacttattcatataaagctttgcttcttataagaaataactggctttctctttaaaataagctgaagctgtgtgagattgtataaaacattatatattgactaatagggaaaaactttcttgtgtatacaggattttgtaattaaggttgaaaatgtaatctttaaacctgaaaggcttaaaaaaatttttagcccccacatgtaaagtgaaaatgtgatgtttgtctttctgtgcctgctttatttcattcagcatgagttccatcatgctcattcatgctgcctcaaatgacaagattttattatttttatgcctaaatattattcaattgtgtatatataccacattttctttatccattcatcctttgatagacagttaggatgattttatatcttggctattgtgaatagtgctccaataaacatgagagtgcaaatatttctttgacatactgatttcatttcctttggacacatacccagtagtggggttgcttgatcatatggtatttctatttggagttttttgaggaaacatcacactgttttttataatggctgtactaatttgcattcttatcaacagtgtaagagttcccttttctttgcatcccacttgcgtttgttattatttgtctttttcatatgaataatagccattttaactggggtgagataatatcttattgtggttttgataggcattttccttatgattagtgatgttgatcgttttttattatacctgttggccatttgtatgtcttcttttgagaaatgttcatccaggtcctttgcccactttttgatcaggtcatttgttttcttgctactgagttgagttccttaaatattttagatatcaaccccatatcagacatatagtttgataatattttctcccattctatagattgtctctttattctgttgattgtttccttctccgtgcagaaaatttttagtttggtataatcccgtttgtctatttttgcttctgttgcctgtgcttttgaggtcttacccaagaaatgcttgcccagaccaatgtcctgaagcctttccccagtgttttttctagtagtttcacagcttcaggtcttacatttaagtctttaatccattttgattttatttttatatattatgagagaaagaaatctgatttcaaatttctgatttcttttgcatttagatatctagttttacagcaccatttattgatgagactgttctttcccttatatattcttggtgcctttgttaaacatgatttggttgtacatgtctggatttacttctgagttctctattctttttcattggtctatgtgtctgtttttgtgtcagtaccatgctgttttggttactatagctttgtagtatattttgaagtcataaagcctatgcaactattatcaatctgggcacatggatggcattcaatatacattttttctttcttaagagtcattcaatcatcaaaatttgggaagtttttggtaaatataggactttaacttttgtgaaagttaaaaaagcaaaagaagatcttcccccaaataagaaaggatctagtgttggagagaacagaaacacagctgaaaatattcatgaaaagatgtggaacgtaagctcagggtcaaccaaggatattaatcagactattaaatgtattctcttctaattagatctgaagtgtgtttaccctgcttaaaaaagtggaccagctgataagtaccaaacaattctggagcgatataaagagaggcatcacccaaagaaggtcatgagttcactggaaaaatgaagtaacactgttgtcatgagtggccacagtaatagccagaagagattgaatgtgccttaagtttaaggataaaaatgtaattgtgatgggaggttggagaggaagctaggcctgtagccaaagtatggaaaaaaaaaaaaaaggaaatacagacaaaggtagcaatagagttgggtgatttaggaagctaggtctgtgaacaaagggaatgtaccaggttcctcccttcatgcggtgcccagggaacactttccagggctcaagtgccctctaaaggcatcactctgccaggttggactcagagccaaatgtaattgtgctgctctcttccattcaagtaggtgcctttgtttaacataagtgaccacttttaaagagctcagtcttcttggttccactcttgaactttcagtgttatcaacaaaaacctgttttgttttcgcattttcccctcagtgccttagcatggtgtcccaaacacttcttgatgatttttaatacttggattatacacataatgcccttctcaatctcccttttacttcccctcaaataaaataaaaaatttaagatactgcattcctgagtccaaggattgttacagttgtcacccccaaaattaggacaataatcacacaaattacaattcttctattcagaacataaatctgatattcttgagctcatttgataaatattaagtatcctcatatggtttctggtttacatacatttgccatgtataatatccataagccattctgggtgtgtgtccctattttataatctctagttgggagggagagcaccaagcctttaaattacgatctcatgcagaataacagctcagggtcaaccaaggataatgatcagaccattaaatatgttctctactgttcggatctgaagtgtgttgaccctcttaaaatagtggaccagatgataagtaccaaacacttctggagggatataaagagaggcatcacccaaagaaggtcatgagttcactagaaaaatgaagtaaaacttattcatttcatgtcagctgctaaaggatgtgctgcagggtgtagggtgtggcttaactgattacccattacggtgatcctaatagttttcatcaatgagaatattgtcaccgaatcttagcatttttgaaatgaaatgttgtggctctattatgtagttctttttgccagtctctgaaatcagttttttaaataacttacctctaaactctcgctctgcatttccttttgtttcctggatgtgaatgtggattcattggtagatgttaggcaaaggctaacttatcagtcatttctaggctcttcaaggtgaagcaatgcccacagacagtcttagaagggaattctgttctctcctttccttatttattcaaagactttcagattgtatttcactattactagagaattctttagtaaagctggatggattcttcaatgcattgggaacattcattcatggaaattggctctattgcagtgtttctcagacttgtgtatgcatacgagtcccctggggatcttgtgaacatgcaggttctatcctgtaggtcatttaatttcactgaatttgtgcaatgcaaaaagtccctttctgaacctgaatccacagataccagcataacctggagcctgttagaaaggcagactttcggatcctactccagatccatagaatcagaatctgcgttttaacaagattccagagggaattcatttgtacaaaatttgggaaacatcatcctgaaaatcacgtaggatcagctatgtaatggcaaaagcaaaagcaaacttatggtaccttctcttttttatgttattctctgattattccctgaggatgcagctgcatataatacggaatcattcatgtaaagagaagcaacctgtccaaaataccttcctttttgtattgaatcttgaaacagtgatgtcatttcctataatataccacatactaacagttgcaaattggtatctgagggctgtgtctagacagaagatatgttttgttggttattttgtttgtcctgtggatgattaaaaggcaatgttattgggcaggtgtgagcagttagcagctattttttcacatggagaagataatacagaggtgttatgcatagtatctataggcatttgagtctggaatccttaagagtaataattcccaacataaattccatggaacagtaatgtaagaatgattaacaggtattatttgaaaaaataaaaaaagtttctgtgatgcgttggcatgataaacagtgaaacaaaagaaatttggggggaggatattacagaggctttatatcataatatgcagtttgaacctccactgcaacatttctcaagcttatttactcaggaaattctgtgtctcaaatgattagagttctatagaacatactttagaacaggagtcagcaaactatagcctgcagactaaatccaacctgccacctgtttttgtactgcctacaagctaagaacagtctttatgtatttacatgtttaaaaccaaaagaagaagaatatttcattacacatgagaattctgtaaaatccaaatatcggtgcttataagtcaagtttttttggaacacaatcacactccttggtttacattttgcctttggcagcgatcatactataagggcagagttggcagctgagacagtgatcacatggcctgtaaagctgaaaatatctattatctgaccctttaaaaaaaagtttgccaacacctactttagagcacactgcgattcgattaccgcaactttttttttttttttttgagacagagtttccgctcttgttgcccaggttggagtgcaatggcacgatctcagctcactgaaacctccacctcccaggttcaagcgattctcctgcctcagcctcctgagtagctggaattacaggcacccgccaccacaccctgcttatttttgtattttcagtagagacgggatttcaccacgttggccaggctggtctcgaactcatgacctcaggtaatccacctgcctcagcctcctaaagtgctgagattacaggcgtgagccaccgtgcctggcctgcaattacttttgcaccaaccaaataaaaaggcctggcttcctcaaatgggaaatgataatgataacatagtgtcttttttgatgagtataagtgtactaacgataacattgtgtagcaaataaatattttctcttgtagacactttgaaatcaatgtaaaatcatatcaaatattcattttactacattataataagaattcctttctggggattaccactgttttcagacttttaagaaatagagtttagatttgataacaaatttttgcaattttcagttattacaacatgtgcctaagtatattttaagctgattaatcttttcaaactttttagtctcaggagccctttacactcttaaaaattattaagggcctcaaagaaattttatttttataggttatatctatcaatatttcagaaattaaaattgagagaatttaaaaaagtattacgcattttaaaataataataaaccattttatataaatatcaataacatatctcttgtgaaaataactatatttttcaaagagtggcatttttgaaaaaatctcattaacatctagtttgataggagatagctaaattctcatattacttctttatttaactgttgtgctattacacctcattaggcccctggaaaactccactcattctttgtgaaagaataaaagtgatctcaaaaaattttttaaaaataaatcgcatcaagtatcttatctgaccacaatgaaaaaaacctagaaataaataataagaggaccatgggacatttggaactgtgcaaatacatgtaaatgaaacaaaaagcacctgtccaaccaatgagtgaaggaagaaattaagaaggaaatgtaaacattccttgaaacaaacgaaaatagaaacacaacataccaaaacctatggggcacagcaaacatagtattaagaggcaagtttatagcaataaatttttacataaaaaagaaagatttcaagtaaacaacctaatgatatacctcaaggaattagaaaagcaagaacaaactaaattcaaaattagcagaaaaaaagaaataatgaagttcagagcataaataaaatcgagactaaccaaatagaaaaaaactcagtgaaacaaaaagttgctttatgaaaagataaacaaaattgacaaactattagctagactaagaaaagagagaagacccaaataaataaatgaaatcagatctgaaaaaaatgacatcacaactgatgccacagaaatacaaacgatcattagaaactattatgaataactatataccactaaatttgaaaagagggagaaaatgaataaatttctggacacatacaacctaccaagattgaaccaagaagacagagaaaacttaaacttacccataatgggtaacaagattgaatccataataaaaagtctcccaataaagacacgcccagaaccagagagcttcaatgctgtctaccaaacttttaaagaacaaataccaattgttctcaaactattccaaaaatttgaagtggagagaattcttccaaactcattctatgaggtcagcataaccatgataccaaaaccagatgaggacacaacaaaacaagaaaactacagaccaatacccctgatgaatatacatgtaaaaatcctcaacaacagactagcaaactgaatcaaacagcacacaaaaatttcaaacaccgtgatgtagtaggatttatcccagggatgcaaggatggttcaacatacacaaatcaataaacatgatccattacaataatagaatgaggaacaaaaaccatatatcatctcattagatgccaaaagagcatttaataaaattcaacatttcttcatgataaaaactctcaataaactaggtaatagaaggaaaatacctcaatacaatcaaggccatatgtgacaaacccatagctaacaacatactggacagggaacaactggaacaagacaagccactcttaccactcttattcagtatagcactagaagtcctagccagaacaattaggcaagagacagaatttaagggcatccagattggaaaggaagaagtcatattgcctgtgtttgcagatgccatgatcttatatatagaaaatcctaaaggctgtaccaaaaaactcttagaattgataaacaaattcagtaaagttgcagggtacaaaatcaacatgtaaaaatcagtagtgtttcacacataaactagctgacaaacaaatgaagagagtaatttcatttccaattgctacaaatacaaattacccaggaacaaatttaaccaaagaggtgaaagatttcacaaggaaaactataaaacacagatgaaagaaattaaagaagtgcactcaaaaaaggaaagacatcccaaatcatcccaaattcatagactggaaaaattaatatgttaaaatgaccatactatccaaagtgatctatatatttaatgcaatccctatcaaaataccaatgatagtcttcaaagaaatagaaaaaaaatcttaacatttgtatggaaccacaaaataccctgaatagccatagcaatcctaagcaaaaataacaaagctgaaggcatcacattaccagacttcaaaatatactataaagctatagtaaccaaagcaacatagtactggcattaaaaacagacacatagaccaatgaaacagaacccagaaccctgaaattaattgacatatacaaagccaactgatttttgacaaaggtgcaaagaacattcattgggaaaaagacactctttcaataaatggtgctggaaaaactggatatccatatgcagaagaataaaatcagatccccgtctctcactatatacaaaaaccaactcaaaatgggttaagagctaaatgtaaaacttgaaactatacaactgctagaagaaaacaggggaaatgcttcaggatgcttgtctgggaaaatattttgtgaataagacctttaaagcacaagggacaaaagcaaaagtaaacaaatggaattgtctcaaactaaaaaccttctgcacagcaaagtaaacaatcaacagagtgaaagagacaaccaacagaatgggagaatattttttcaaactattcatctcacaggagattgaaattcagaatatgcaagaaactcaaagatctcaatggcaaacaaaaaacctccaatcaaaacatgggcaaactatctgaatagataattttcaaaagaagatagacaaatgaccaacacatacatgaaaaagtattcaacatcactaatcatcagggaaacaaaactagaactacgatgagatatcatctcatcccaagtaagatgactgttatcaaaaagacaaaaaatgacaaatgccagccaggatgtggaggaaagggatttcttacacactgttggtgggaatgtaaactagtacagccactacggagaacagtatggaggttcttctaataaatcaaaataggactactatatgattcagcaagcccacaactgggtacttattgaaaggaaagacaattattatattgaaaagacttctgcaccatcatgtttattgtagcactattcacaatagccaagatataaagtcaatccaagtgtccaacaacagatgaataaattaagaaaatgtggtatatacacaatggaatactattcagcctttaaaaagaataaaatcttgtcatgcatggcaacatggctggaactgaaggacatcatattaagtgaaataggccagaaacagaaagttaaacatcacatgatctcatttctatatgggaacaacaaaaaaagttcttggaagtaaaaagtagaagagaggttactagaagctgggaagtgtaggggaaaaggggagatgagaagagatttgttaaagtatacaaaattacagctagaaagaaggaataagttttaatgtttgatagcactgtggaatgactataattaaccataatatatatttagaagtagctagaagagagaatattaaatgtttccaacacaaagaagtgataaatgtttgagatgatggatatgctaattgccctgatctgatcactaaacattgtatatatcaaaacatcaatatgtgccccacgaatatgtacaattcttatgtgtcaattaaaaacataaattaattaaaaaattaaaaaaactagttagtgttgagaaggatgtagaccatatgtaattttcacacattgatggtggaaatacaaaatggaacagttattttggaatacagtttagcagttctttataaagtcaaacatatatttaccatatgccccagtcatccatcttctaggtattcatccaagataaatgaaagcatatttttgtacaacagtttgttccagaagcttcattctagccacaaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtatattttatctcaattaaaatacatggataatatccctccctaaaaatgagagtgaaaaaggcaaataatgtcttagaattgttatgggccctctgaaggtgtgtcaggggcccccagggttccctgtaccacactttgaaaagtgttactcttttgtaactaagaatgaataatcatatacatcacacacacacacacacacacacacacacacacgtgcacactcatacacacgtttatactggtaaaaattatcaacaatcttcaatttaggaatgaagtgtttcaattgtttgcttataagtatcctgtttgcttgttgagcccaattgacttgtactaatagtatttcagaacccatctgtttaggtatttgtgattctgtgtataaatatagagagagtccaacctgggtgacaggaacatgactcccttcttgctgactagtaatggtgctggaacctctatccccgcatcactccttacctgttagtgaaatttgggatttcttcagccccaagctactactggggttcccctggccagggttggaggtaagaacctgatgaaaatagggacttgggatatgagtaggtaggtgtgaaaaacttttcttttatgaaatgcagggattagtgcaacatttttttcaccctcttgcttctgtgttttggatcaagtcctgtcttgttctctcctgtttccccatatcctcctatatttgttagacctcttacaattcaaactagcttacttaaagacaagataatttgttggttcacattccttgaaaagtccaggtataaaaggtagaggagctaacttcagacacgtttagatgtcatcaggacgttttctctctgtgtctctaaactctacttctctgtgttggcatcatttctagttaaactggtcctttccgtgtggtgaaaaataaggctaactgaatgcatagtcatcgtggaaggaaagaaacctgcttttttaccagtgattaaatcagtcccagattaaatgatgccagctggccaaccagggtcacaagccagtttcttagtggaaaaaggaagtccttgactggaaacccctccagaatacatggaaaggtgtaggagaattggagaagggattcaggggagacagcaagggaaaaatttgtcctgcaattcttgtttctaagtgaaatcaaggaccttttgaagttttctgaatgtctttgcaatttttaaattttcattgacaatttgaattaatttgctataataattaattgctttgaaggaaactgagaaatagattccaaactgtagataagatacagacttttagaaatgtcactcttcaactaacctagtattcttcaaccccagctaatcatggctgcatgctccttagcttcatgatcaatgtatgtagctgtctgtttctgtcttgatcatttctgaagctgctgtttccttatgttttctcaacacagaggctaccatgccttttttattgagggggaagctgagacttagtgaagtcaaataatttgtccaaggtctccattagtaagtgacattatagaactgaatccttttcaccccaagctaattttctttccaccataggctctaccttccaattaaacctcttgctagccaaatatgttctaaatttgtttattcattttccaaatatttattgacaggcactcttctggacactgagggaggatacacaatgaagaaaatagacaagttcttgttctcatggtgtgaataccctagcggaagggcagaaaataagcaaataaatatatatgatgtcacatggcaacactactggcaagaagaggattggaaaagtgtgctttttaattaggatgattaaagatgacgtctttgaggttacggttgaccagagccctcattgaagccaggaagcatggcagggagatagtgaaggaagggcatcccagacaggagaactggaggacaaaggctctgggtgtgaaagtctttggcatatttacagggaataggatagaggtggggggacctggaactgttaaggggttggggtggaagcagcaggagattaaatcagagaggtagccagaggaggttttatccagagagaccagagagatggcaaatattcaactgtgtgttctcattctctggaagaagaaaacactttatcattttacagtgcttaccttgagaatatgaaaaaagagaatcttttatcatttcagtcatctataagtgagtattcaaatttatatgttcaatcatttagtagttcattcttacagtcaacatttactaggcacccactgtaccctagatactccgccagatgttagagctatgaaaaaggaaaagagataccattttctatcctccagaaccagatgtgagtatgttgtatacaactggaggatgatcaggttgacaagagcatcttgtattactgtccacacattttttaccccccaaaatgtgtggtttccacaagaactagctggaagcctgccatttactgacacattgctacaaatttttaaattaaatgttttactagaaatggattcaatgtggtaacggatctgtctgactacgtttcagaagggtttaaaagcatttaatttccatgtcacatccattaaaagttaatgatgtcatgcactccagggagcaatccatttcataatttaaagtggaaccaacaaaacacgactcaaaagggaaatgaaggtgacaaggtacagaataacatgaaccagtgtagctgcacctgtcatgacccttcccggggttaacctggcagagaacagagagtttaagggaaatgaatcagagaaccaagccacattccatcttcctcagagagaaaagagcataaatcaggaagaaataaagtttatgtgatatgcagcacacatttttagcgttggtttccttcacactgaaatgaggaaaacagagcataaggaaagccacgtgaggggactgcataatgagctgtgggattccagaggatgtagatctccacgaaccctctgactccacacttgaactgtgaggccaactggcaccctccctccgtctccacactgcctgaggctctttcctgtgcctgcgcttctgaacaacagaggaaacccagggatacgctcttcccaatactcactcccctgcccttccagctccttccaccttgtttacatttgtactcgcgtatttcatgtgggttgtgaaagctggtaacgttatggctacagagtgctctattatattttcaagggcggaaaaaggctgtatgtgaagctgccaaatcaaatccttgccaaaatggtccaagctaatgagaaggtttgtaaattacagttcaatggatgagacgtggaggacaaggaatatcatgcccacccagcaaatagaatcactgagcatcactagcttttttactggtatatatatatatatatattatatatataatatatattatatatataatatatatatcttttttgcactatatatattttgcactatatatatactgcaaaatacatatatacatattttgcactatatatagtgcaaaaaatatatatacatattttgcactatatatatagtgcaaaaaatatatatacatatttttgcatgatcttagtcaaagtattcaaaaatttaagcatttatagagtaaagtttcatcaattcctatacatttaagctggaactagatcgggtgttacttaaactgacaactaatgcaatgttttatataatacagatgatcaataaatttctgcttaatgaaagaataggtgtctacaaaaataaatagacacatttagattgcagaaccaataattaagggcaactttaccatttgagtctacttcctgccccacttcctccccacagtaaagtttagaattttccacatattctgatatgatttaattttaactagtcctatcacttatcagctcatttctagactgattaatggacatcgaccaattttaatttataaattggtcttttccctgtttctttagattttggaagttttgtgtgcatttgctttggagccaaacacgagaagaaattttaaaaatcacagctctttgagtctttaaacatttttcaagttataaagtcatttagtttcagagacttttccattttctagctgaaagcaatcaactttaagaatccctatataagaattcctagaagtgcctggtcagaaaattaaagcagaggaagaattgatttctttgttatagtttccataatcatttaatcagaaacaatacaaaaaattaatccatttcttaaaatgtttacatgacactttctatgcatattcattaaaaagtataaaatatttttgtaatggatcaaaatttaacaaaatttaatttattttattaaactaagttttttctttaataaaaacaatcatgataattaagaaaatagaaagcattcaagttaaaataaagccagtaatattccacactatcaagcttaaaacatcattatgaaaattttgaagacgttaattttagatgtagggaatggtaattgcttgggctttgcctgcacatcagtagcaatgatagtcagatacaaatttagactttaacttaattcctcttttcctgcaggtcctttctcctgtataattatactcaatcattaaaaagaaatgaactcaatatcttaatatacatggaattactctgttgtatctacaagaagcacatttcctattttcaataagttgagttgaaaagaaaagaatgcaactttttgaattattttgtaaaatgcagttagtaaaagctttagtgttgctttttgtctttaatttgttttgttagttgtttctttctgtggtattcactatgatgcattttgtgttgctggaagctagtggtaacaatgcaatagacaaaaatacaggggagtaaagaatgaagggaacagaagaaaaaaaggaactatgagacttttcatgtgacatgttctagagctcagtacagagtactgtggagtttggttttaggtggagttacctctgcctattggagtcaggaatggcatccacataaaaaaaatgtatctgaaaaatgtccaaagcaatctacagattcagtgaaatacctatcaaaatcccaattttctgtttttacagaaaaagaaaaaaacaatttcaaaactcatatgggaccactgatgaccaccaatagctaaagcaatcccaagaaagaaggacaaagttggaggcctcacacttcttgatttcaaattacattacaacgctgcagtaattaagagtatatactatcataaagatggacatactgcccagtggaacagaatggagaacccagaaataaattcacacatatatggtcaactgatctttgacaagggtgccaagaatacacaacggagaaaggcttttctcttcaacaaatggtactgggaaacacacaaaagaatgaaattgtacctttctattatatacaaaatcaaatcaaatatattagaaacttaaacctaagacccaaaactgtaaaactccaagaaaaacatagggaaaaactttatgactttgtcttggcaatgacttcatggatataacacgaaaaacactatcaacaaaaacaaaaacaacatgagactacatcaaactaaaaagctcctgtgcagcaaaggaaacaatcaacggagtgaaaaggcaattgatgaaatgaaagaaatatccatgaaccatctatctgataaaggactaatctccaaaatatataaggaacttctataattcaatagcaaaaaaaccacatgacctgatttaaaaatgagctaaggttttgaatagacatttctccaaagaagatacaaatggccaacaaatataagaaaaaatgctcaatgttacaaatcatttggaaaatgcaaataaaaaccaccatgagattttacttcacacctgtccagatggatatcatcaaaaaaaaaaaaaggacaaaatgtactgatgaggatgtggagaaataggaacgctggcacactgttggtggaaatgcaaaatagtgaagctgctacagaaaatactatgaagattcctcaaaaaattaaaaatagaacttccatatatatgattcagctattccacttctggatatttatcaaaagagttgaaaccaggatcttaaagagatatcagcagcactattcgcaatagtcaagatgcagaaataacctaaatgtccattgacagatgaatagatacagaatatgcgatatatacattgaaatattatcagccttaaaaaggaaggacattctataatatgcaatgacatgatgaacctggaggacatcaagctaagtgaaataagccagtcacagaaagaccaatactgcattattccacttatatgaagtatccaaaatagtcagattcatagaatcaaagaatgaaatggtgtttgccagggaatagcaggaggggggaatagagagttatgaatcaacaggcataaggctccagtcaagcaagatgaatgagctctagagatttgctgtacaacattgtacctagagtcaacaatactgtattgtctgtttaaaatttgttaagcagtaagtctcatgttaagtgtttttaccacaataaaataaaatagtaaaataaaatgtacctgagatgagacttgcagtcctgtgtgagggacaggagtttgcccacagaggagagtgaagatggagagaatgttacagacaggccacagcctgctttgggacctagaagtgagtaaacaggctccctacaggatgtgcagacagctgggcctggggagagagtgccggggatgctctgagggccactgggaggtgaggctgtaaggcaagttgtggcagaccatcacaagcccttcatagacctgcaagagacttccaggtttatggtttgcctaacatgaggggctactgaagagttttgtgcaagacatgtgatgaagtatttgtgacatgataaaatgtcgtttcagccatcttaaaaccactcaaagttgacggtctcctctcctgcctcctgcggcttccattaccatggcagagactgtggtgtctgaggtggtgtagcgtactgaagcaaggctgtcttgaagaagaggagacaactcagtaagtatgttagtcagcataagctaggttatgatgcagtaacaaacaatgcttacatttcagtggcttagcacaacaggagggtatctctcactctttctggatgccctacagaagacagcgggaggtggggtgggtctgttccacagtgtcactcatggaccagactctgccatcttttgactgcactatctccaacacacgacctttttagtcaccacatcaggggagagacaactgcaagggtttgcagtggctcctttatgcttcacaatggaagtaacacatgccatttctttttgtagtcacagccaattccgtagctttgcctaaccacaggaggctggaagacggggtgggggggaagcagatgggtgcttgctgagcactgcagtctctgccatggtaatttcaggtagctagatggaagccacaggaggcaggagaggagaccatcagctttgagtggttttaagatggcagaaacatcaggccacagagactgaggcaatttggtgggggtgagagaggagtggcatagggtgattgctgggtactcactggtggcagcatactcagtgagcaaaactggcagagagtaggtgtagggtagagataaggctcatcttgaccagcactgctatctgcgaagcctaattaaacatgtccacggccggtcgcggtggcttcatgcctgtaatcccagcactttaggaggccaaggcaggcggatcatgaggtcaggagatctagactatcctggctaacacagtaaaaccccgtctgtattaaaattaaaaaattagccaggcgtggtggcatatgcatgtagtcccagctacttgggaggctgaggcaggagaatcacttgaacccaggaggcggaggttgcagtgagctgagatcatgccgctgcactccagcctgggcgacagagcgaggctctgtctcgaaaacaaaacaaaccaaaacaaaaccacaacaacagcaacaacaaaaaccccaaaaacatgtccactaggaactgcaagtcaggagtgcaaaatagagtcaggcctagctattgatatttggacatcatcacccagttataggcagaggttgaaaacatgtaggtgaatgagtctcccaaaggagagaatgtataataagattaggtgagagtttaaaaagttgaattgctcgtgcagtctggatccagagtcatcgcacccagatggattcaagaaatggagggtcagaaggtcagcttccacaagtctataattaactgggttttgatgtatgcttgcagaggctagagacacactgagagatttatcgagtgcaatatttgtttgacatccaaagaaataagacaagccttcttatgaactcttggcagagatttactttagatagcgaagaacagcttgacactacagattattagacaccacaagagtttattaaataaaatgggtggaagcattgattctacatcttaaatatatctctttggtccaggggttgtcaaactgtgtttcttaggggggtctcaggggctgctgcaggatgccaggagctggtgcagagcagagtgactcacgtcttccacctctccctccatcagctctgcggttactggttttatattgtaatgtttcacataagatttcattggagaaaaaattctgcaccacaaaaacaaaaagtttcctttccatctccaatgttaaaaagccttaggctgaggctttcatcatttcctgcttggatcgttgtatttttcttccctgggggtctgtctcgctgcctctgatctcgtccctttgtcatccaccctccgcatggttcccaaagtgatcattctcgaacacaaatccaaatctgatgttggcttctggggcatttttgacttcctatcaccaattgtagaaagttatactctaaagaatggccccaagaaagcatttcatgatttggccttcccttacctttctccagcccccttttcaggatgtccccttttgttccttgtgcctcagccataaacaacaactcatgcctgcagtgcgctgaaggtatagaaggcctttggtttagtgaatccaacttctcagctgcagcttcagcataatgacatcttagaagactccccagcttccagtagtttagttagaagtcctcctctggggctcctgtcatgaagaatgtgtacccctctgacagcacattgcccgcagtcttgtgttaattgatatttagtttatctccctactggataatcagcaattgccttcaggaaacggactggctcatcagctctatctcctcagactttggctctgcacttgaccctctaccatgttgttaaacaagaaatgagtgtcctcctttctggaaatcattaaaataatggttttttatctgctttattcatttgaaaagctttggtctatgaatatagactatacggctccttaagatttttgtctatattatttttgatttttttgttttttaacacctttagaatttcacagcctttataaatataatacttaaaagtaacatttcagagtatttggaaatactttttgactatttaaaacaaaatatgaaacatgaagtatagtaaagatataaaacgataatttagataaaaattctttctttcatggaaaacaccactgcattattcctgtttcaaatgtcctacagcattacatttttttttttttgcagcaactccactacacatttgttcatggtgttcacttcctacaagatacagtcaaaactccttagcctgatttccagagcctctgtaatctgacccaactgactttctcaaccacattacacactaatctttcacagatttttttttgctttatttaaaccttttcccctcatatttctatttattcttcttagcctttggtgaatgctttctatcagaggatttgtaccttcggatttttggaaaagtctgtaccattatatcttagcatattgcttatttgctgtttgtttatttatgtctttggaatttctctgaggcagatactagagcatttatgattcctaacttctgttttatatcctccattcctttatttttgtcctccatgtcacagagatgttctgttccatcttctaactcatcttcaagcatgatttgtcttgtataatccatttgcttagatttctaaagagatttaatgactgtacttacacttgacttttaagagcctgtttcataacttgctgtttttattttacagatgccatttcttcctttatattttaaatactgtaaacatacttattgtcagctctctttcatgttgttctattcttgttggttcctcatgtcctgtaagctgtctttcatgatgctaagtgtcctattttttaaaattctgttttattttgcttacgagtttacttcagaaggaagtatcttttctagagatccggataaccacctggggtggtttccactggtgttcctgtcagcaccttcaagacacactgattctgaattattttttgtgttagtttttcagcctggaattctgagtctattcctactcccacctgttgttcagtcttggggttcttatatctctagaagactcctattttacccacatggtggggctattggctcatttccagcagttatcttgggtatgcaggcagagatgatctggttccttcaaggttagtgcagtgctttctagggttctgattctgcacaggaagcccagttcttattccttctataaacatattttcctggccagcttctggccttgaatagccatgaaaatcccagactttgagacctgtaatctcccttagttccagatacattgtcatgttggctctatgttctagcatttggagatttcctttcttgcttttgtgttctgctatatatttaatatgtaaaaaaatgcttttaatccctatatctaaatgtctggaaatgttgtgttcaattccatcttatcctgttatttcttgactgtctgaatatgtagttcttatttctctcgttctctccattttgaataatctcccaaatgctctctgccttttgcaaattcactcattcttccaggacttgaggagtcactgaaggtaatgcttttttcctccagggaccaaattaacccctaggaagggtcttctatgaactcctttgacatccatttgacacttaatcattttctgttataattattatatggctattatttgttttcttgtgaaattataaaatctttgaaatttggggccatttcttaagcttcttgaatttcttcacctggtctcacaacaaattcttcctaatggaagaaaaacagaaaagaaagacacactaggatagagtaatttaaaatgttttagactttatttacgagggtccaagcacctaggaaaacaggatttgtttaaattttgcttactcattttattcaggattcatgaatttataaggccagagagatttcatataagatcctagattactaaaggaaaactgaaagattttatgtcaagcaatataaaattaatatgacagatgcaaccttagaaaatgtgtttcctgagattcctaaattagctacttttgtgggtgtctgcttagtatttggtcctgagtaaatgaataaacaaacagctacttctgagagctactttcacagggaaatgtttctgagttccagttcatgggagtttaggaaggtatgggatgcaaattacatttcaacactgaaccagccaatcaatccttgaacacttttgaagtctttagctttgcctgtgaacatgggaacacccaagggcaccttcaaattaaaaataaacatacattctaaggagtcctagatgtgtaatttggtagaaatttaaggggtgtctttttatagtaacggagtctataaagaaaatacaattcaggtgaggttacatcctttccagtcataaaagtgtatgtgaatgacatttaactcgaaattcaagtactttgggcatatcattcccgctccctgccccaatcccataatttcttggtagaaactcatagtgcatttttttttcagttccagccagatttttatatctattggatggatattacattaataaaaaaatagctaacacttattgtatgattgtctaatgccaagctatgttcgtataattatctaatatgttggtatgatttgactctgtggctccacccaaatctcacctttaattgtaatcccttatgttatgggaggaacctggtgggaggtgattggattatgggagcggtttccccatgctgttcttgtgatagtcagggagttcttaccagatctgatggttttagaagtggcaatttcccctatgcactctctctctctcctgccaccatgtaagacatgccttgcttctccctccccttctgccatgattgtaagtttcctgaggcctccccagccatgttgaactgtgagtcaattaaacctctttccttcatgaattacccagtctcaggtattctttataactgtgaaaatgggctaatacccagataaccctatggtgttgctgctgttattattcttcccttgcagatggggaaaactgagatgaagagttaattaatttaccaaagtcaaaagagtagtcttaaactactgtgaaatttctgtaggcctccttttttttccttcaaaacctttaatatgctaatacacatttttgtattttttttttaattatactttaagttctgggatacatgtgcagaacatgcaggtttgttacataggcatacacgtgtgattgtggtttgctgcacccatcaacctgtcatctacataagatatttctcttaatgctatccttcccttagccccacaccccactgacaggccccggtgtgtgatgttccactcccagtgtccatgtgttctcattgttcaactcccagttatgagtgagaatatgcaatgtttggttttctgttcctgtgttagtttgctgagaatgatggtttccagcttcatccatgtccctgcaaaggacatgaactcattcttttttatggctgcatagtattccatgatgtatatgtgccacattttctttatccaatctattgttgatgggcatttgggttggttccaagtctttgctattgttaacagtgccacagtaaacatacgtgtgcatgtgtctttatagcagaatgatttataatcctttgggtatatacccagtgatgggattgctgggtcaaatggtatttctagttctagatccttgaggaattgccacactgtcttccacaatggttgaactaatttacactcccaccaacagtgtaaaagcattcctatttctccgcatcctctccagcatcttttgtttcctgactttttaatgatcgccattctaacgggcatgagatggtatctcattgtggtttttatttgcatttctctaatgaccagtgatgatgagctttttgtcatatgtttgttggctgcataaatgtcttcttttgagaagtgtctgttcatatcctttgcccactttttgatgaagttgtttttttccttgtaacattttttaagttatttgtagattctggatattagccctttgtcagatggatagattgcaaaaattttctcccattctgtaggttgcctgttcactctggtgatagtttcttttgctgtgcagaagctctttagtttaattagataccatttgtcaattttggcttttgttgtctttaggcctcctttctattcatgtttctactttagaagacatatatatatatctacatatatatatattttatatatctatatatgccttctaaatatatatgtctacaaatatgtatgtcttctatattttatatatctatatatgccttctaaatatatatgtctacaaatatgtatgtcttctaaagtagaaacatgaatatatgtatctagaaacatatatgtcttcagaagacaaatatatatgtatatgtcttctaaagtgtgtgtatgtgtgtatgtttatatatgcgtgtatatatatatgtgtatatgtatttgtccagagttctcctggggaatctatattttattgagatgagaaggaaacgtggtagtgttggttaacttatcaccacctggttgctgtctaaactcaaccacttcctattgtgtcatggtttgattataaatttcctctaagcctctttttctggacactcgcttatcaccgctaatcctacatacaaaaggttgaatactggccactctgaaagttgacaatctaatatggattaaatgtaaaaataaagctagtgactccaaaacccaccactagctggttcatcacagttgtatatttttacactttctcagtccaccctctaacccaactcatcttcttgtaagcctagcacctattgttggctatctagtggcacactgcaaaggatcttatgtgcctggagccccggtttgcaattttttttttttttttttttttttttttttagagatagtgttgtatacttaaatcttgacaagcaaaagaaaaagaatgaagtttggaaaccatcacttctaaaaagcttgtattttattatttagaacagacttgcttaagggaaagataaaatcaatactttttccccctgttttcaataagtgcctagatattagattttatgtttgtttgttttaaacaacgttttaaacttgagagaattttgggtaagaaaataaataaataagttggatagaaataaaccttttaaaattaaattctcttcactaaagaatgtattactgggaaaggttttaaaaacttcactagaggtccctccaatttttttcacctgtttcctcaagatggggtagtcgaggacaaattgattactgttttaagcttccttccaaatttccattgctgttatttatggttctattccaaatgtaaaatttaggcctttccaatatttgtttttaaaatgaagagactttctgattcctatgaataaaaatactccatgctaatggaaaaatcaagaatcttggtgccaaagtgcttcattcaaactcttagacaataaaataagcaagacattaaattataacaaaggttccaaccttttactaaactagactcaccttgaggagcttataaaagtacagatttctaagttttcccaatctactctttcttcccatcccaagattctgaaattaattggtttggctgagcttgatccaacacattttactaaatatatatgtttattatatatagtctatattataaaataaatataattataacagaataaatataataaatatagtataaagtatatttattatataattatttaaggctgaagatcagtgtccacaaaggcatttcttgctctttgctaatgccagacaaattaatgcaaaagaaatggttggataagaagaaaggaaaatgagaaataatattcctatttataatttctatctattttcacaaaaatcacaagtagctaaaggtagtcattttgcctcaaattgccaatcaggtttaagaagttttttgtctgaatttcctaattctaagtgagagactgaaaatgcaaatgaactatgaccagaccacctatgacaacagaaccctgacccacaatctctgtggccaccagcccaggaagcaaaaccccacttctgtggccttcagcccagagtggtcagggcttggtcaatgactgccagctttccttttttttctttttttttttttttggcttctgcttccaactcaggaccaaggagagaaagccaaatatgttacccttctctaaacaatcacttaggatgccccacttctagttagtgcacttccagcttccctgaagccttcctttttttttttactgtaaaacgttcccattcccatctgtctttgagtctttgtcaaatacaggtgatggtggctgactcacttgctatggcaagctctgaatcaatagcttctgtttgttctcattttggtggtgtttatttagttccacatagctaaaaatggggaaaataaaaatgggaaaaaataaattatccttgtgcatacatgtaaggttatttataccaatttatgcaatttcagaaaatgagaggagaaagcagataccatcaccaaggcaagtgttcaaaagggcaataattacagtgacaagaggaatcccaataacttttattctcagtaaatatggctacacagtcaagagtgttgaggacctgagaatgggaagtcactgctttggctcctgtgattccaccaatacttgcctgaattctcttgaatcaatgaatcaggcgtggaagactagaagcaacaaagagaggagcaggtagtagagggggtaacttttagaaggctgtagagtggtcccttgatatccacagaggattggttccaggaccacccacatatacccaaatccatgcatacttaagtcgtgctattgggactttagaatccaggtatatgaaaagtcaaatgtgtatatgtgtgtgtatatatgtgtatatgtacatacatacatatatgtatatatatacatatacacacacatatgtgtatatatatatacacacacagagactttttccaaacaaaagcagatcaaaaatactgtatatatatatacatatatgtatgtgtatatatgcatacatatatacagtatatacatatatacacatacatatatgtatatatgtatgtgtatatatatgtatgtgtatatatatgtagtatttttgatctgcttttgtttggaaaaagtctgtgaataagtagacctgtgcagttcaaacccatcttattcaagagtcaactgtaatttcaatattttgtaacagtttagtcaccaatattgaagttgagagaaggaagttctctcttgtggacaatatggaatgctctaaaacttgaatccaaatgtacattcttggcatcactcaaataatgtgagcgtgtaacatttatgatatattcaagaggcaaaacccaattctttacactgtagacctgttttgttgttattttagttttgtgaaggcaaggttttaaggcaatttagttctaaaagcattactgagtatttactatttgcaattcactgcacttggtaataaactagagggagatgcagaaactctcttttctccaccaattcttcgaaggaaaaaacatttccattatcattaggtgacaatctacacagctaattgtacatatgaattgactgataatttacagttgcaatatggtgtcataaaaggagtcataaaactttgtgacttcgtttgctttttctctgtaagatatgtgctgcaaatgcaaactaacatcaaataaataactcctgtctttatacatacatgatctaatactttccacaactctgatatttaaggtacttccattatgactagttaattgcataaattcaataattaattatattctaatgatcaagaagaatatttatcaaaaataaaacttgcagacattggggaggaattaaggcatgttaacacattttctatatcaatcaggtacttttagtgtaaatgtgttatcaagtgaactggaacattaaatagaggaatttggtatcattgtgggaaaaataatctaatcacttttcaaacttggctgccctttggagccatttgagaaatttttgagaagcaagatacaggtattctaatttacttggtctgcagtgtggcccttgccaggtgatactaacatgtggcatagagtgagaaccatcattatataatctagaatttagtgtattactccttcaatattatacttctcctccagctcttgggacttttcctgatttcataggttggttgagcagtttttgttattgttgttgtttgtttttttaatgttgacttgttttcccaagtaggtattcttcctggaaagagatagtactcactataaataattaattgacttcctagtcaaattagtccttgatgagtctaaacagtgggtggtagacatatctcatctccccagtttgatcacgccatccgtccttaagataacagacctatagagctagtaggccaaccctagaaacaaaaaaggcaacagttatgtccaggtcattacagcttgtcaatttgcttctcccaaattactgcacttcttgtttcttcattgggttacacgcctgcttattcacgtccctcgatcagtttttcctcaatcctgggtacacaacagcatcacctggggagcattttagatgcctaatgcctaattacatcagtctctgggggtagtacccagttatcagtgttctttaaagctcctcagaagacactgtgaaccattgccttaggctgtagtgctctcaatatttacctaagacattcatgaatctgcattttctttagttgatattacagagctacagaccagctctgacccaagctcatttatataatggcagatagatactattaaaaacctaaaaaaaaatttaatagaagtctttggtaatgtacttacagagcccttgtactttgggccaggggctcttgtaagcactgtacatagattgaattatttattctagccacatcttacagatgagaaaatttcccagtgttacacacttagcgtttgggccaagattcaaatgaggcactctggctccagagtcaccagttaaccacaggtgaccagcaatgtggctgttaaaactactagatgtgatttgataggtgatattcttacacttccattttacaggtaaagaatcaaggtacagagaaagtgtcctaggatcacacagctagtaagtggcagagctgggatttgaactcaaaacagtcccaccctaaagatgatgttctgttaataatctagccttttttttcagacaaatattcaactgacccagctttccataaatttatattactgcagattggaatttggtattgcaagtttcatttgcacttctgaacttattcttcatgttttacccagaaatttattaaaaaaaaaaagaaataaaactggtggatttttcaccctactacaactgactgcactggagaagcaattactacagagatgctacagctgctttcttgatattagtccacggttttaaaatgtttttgatttgtaaatatgttaggcaccacaagtccgtcaagatggtatgtagaaagaagaaaagattctccactccaaatctttatgtgcctgaaaatccctttgatttcccttattagtttggtatgtctttaattttatattaaaaatacagatttcttccagttatgggacattgtcccacttcaaacttttaaaaacaaattaatcagaattttatggtaattgttatgtaaataggacaaatatatctcagccctttggcaagcagccttgacaactgaaacagtttcacactgtggatttcaatcaatgtaacaaagttactgagcacagtctaaaatcaatgaattctagagtgcaggagttttttaaaagtttcttgcttctcgcattttaatataaaaatcatcccaggctattgttaaaatgcaaaaatctgatttgggaggctttaagtgagatgctggacttcatatttcagtaaggtctcaagtgatgtacatgctgctggtctgtgaaccacactttgagtagcaaggacacagtgctggtaaactcgttctccaaaggaggaaaacaaagccttggcttgtagtatttgctaatttccatgatataaatgttcccacaaagaccacattcaagctaccaacgtgatgtcattgaaaatggagttgggaagagacattcagcacgctgcccacaattagctctccaaccaggtacaagccagttccagcacaccactgatctacataagtataagtacatgcaccttcaagatcccacaacatagctgtttcactctgcaaaggatttcaggaggtgagggagaataagaatgtcacaggaaaaaatgacaagattaattacaaagttttcagaataggtgcaaaataatctagttccaaggctatataggctgatgagagggcatgtttaagaagttaaaagacgtgtgtggccaataatggagcctttggggaagatctgaacccggtttggactgtgatgggtttggatgagtgggaaaggagaacacgcacagaaaaggaagtgggataaacactagcaaaatgtctgatgctaaacaaaattgaaggaaaacttggaattcctaaagagttgggagtacagtcattggtccagcagaatgagggcatcctgctttcacaaatgttttattctctggcatgattgaggaataacatattcagattaatcaaacatccaggttaacagagagttgacatatgtaccaaaaagagatgccaatgtttaaagtaatagaatatattagagtacacagaacctaatttctttcttctttgatgaagaaaggactttgagatcttccatgtctcagagccatggctttgagcacctttggtcccttctggtagggttctgtgatggagcctgcaaagttttgtttgcagtgtcctgtaagaagagtgtattttcaagtctttctctagggctgtagaatgagagcatcctaagaaactgactcccttggagagaatttctaactggcagaaatgctctgccttgtagtgcattgagtggttaaaagcccagactcatttccacatctgtaattggggctaataataccaatctcatatggttttggtgattattaaatgaaacttggtcaagaaatattggtgctcaatatttgaatgagcactacaaattagtgcaggcgttgtagccaggcatacaccgttactaatttttaaatcagaattgcttaacagacactgattgtctacaaggccataaacaggatgaggctgtggggagaaagtatggactggtccccaagcctgcagagctaaggtttctgcattctgcacacatctttgaaagaatctatgaccacctgtgcacaatgtttaaatgcctaggaaccttcccttgctacccagggagaggttttccctagaccctctgacagttccctcagtcagcaactatatgaaagaattttcttacatttctgaaatctgaatagaggtttatttgggaaaaaatccttttccctcctgtctcttggaataaatgtactatttcgttttcttaatttgtactatgttaagaaccagtagagggaacttaaggtcaatctgtctctcaggttgagtaactctaagctataagctccagaatcttgtctttgtctctaattccaaatgggcttgtggggaaaagtgatataaccatgagatcactgtgttcttttagatgatttcctgtttcctgtgtatttaaatacacagggaataatcccgctattaaaatgagaccctgtatgtgtgtatgggcagaagttcaatgaaaaaggaagaaaaatatgcttgctgaataccagatgtagaatgcataaatcctgtcagaacaagtggggaatagcttttatggctgacttgcaagaaacctaagggaattgggaaatcagataggcatgtgtcaagcagacttatttaaatcatccacttcctcagcaaaataaaagtttgagagggttctgcttccttttgtggtttgaaattacagttgtaggcctcagaagtcctgcttgattgagggcttccaagcaaagacgttatacaacctagttcaggcgcccgacaacactggggtcacccaatgcctctccctgaggtctccaaccttgccttgtttgtactttgtgtcctttgtcatctcagaagcaaattgtagtgcagctgaccactgcttcatggacctccagcttgtccctactaaaaggcttttgcatctgaaagagaaagatgcccactggcttccttcttagaccactgctgtagatcctgagcacaaaccttagctctgcaggcttggagaccaggcaatgctttctccttgcagcctcattctgttcacagttcgcacagggtttatggccttatagacaatcagtctgtggtaagcaattctgatttaaaaactaataatctgtgtatgcttggctacaaggcccacatgaattcgtagtgagagataaactagataccaattatttccaggtataatatcctaacaggtaagtttttcaggaggccacattgtagttcagcaggttactggtgtgtatagatacaaagcaaaggtatttaagtacaaaccatttcctttaaggtgtggtagctccctaaattgttcttctcaggatatttctgttttaaaatgtcctgttaaatatattatttttatgtacagtataattttttaaaagcatgctgacatgggaaaatcatggactttgcagacccaggtttaagtcattccaaatctaccacttactgatgtgtgaacttcagcacgttactgtacctctttcagactcatttccttatcttcttgctgagaatgtgtgtgtaaaaatattaatatggaatctagcatggtgtctagccctttgtgaaaccctgacaaattcttattcctcaccattcatctgttcatctgtattagtttgttttcacggtgctgataaagacatatccgaaactgggaacaaaaaaaggtttaattggacttacagttccacatggctggggaggcctcagaatcatgatgggaggcaaaaggcaccttttttttttttttatggagtttcactctgtcacccaggctggagtgcagtggcacgatcttggctcactgcaacctctgcctccagggttcaagcaattcccttgcctcagtctcccaagtagctgggattacaggttcctgcctccatgcctggttaatttttgtatttttagtagagacagggtttcgccatgttggccagactggtctcgaactcctcacctcaggtgatccactcacctcggcctcccaaagtgctgggattacaggcatgtacaagtatgcccagccccaaaaggcacttcttacatggcagcaacaagcgaaaaatgaggaagaagcaaaagcaaaaacccctgataagcccatctgatcttatgagacttattcatgaccacaagaacactatgggggaaactgcccccatgattcagttatctcccaccaggtccctcccacaacacgtgggaattatgggagtacaattcaagaggagatttgggtggggacacacagtcaaaccgtatcactacccatccatccatccattcatttattccttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgttgactgtgggccccaggatgtgtatgatggaatttactgaaacagaatttgcacatttataaaaaggatgcagttttagaaaatagctagttatgctagcatcttgtttcttcattgatgctgcaatgttatataagcactgaatcctcccacatttccagctcttatctaaaagccagaatgtgtaccacctgggttgagaggaagatgaaatgaaattggggaagtaaatggtaaaaagcatcctgaaagaaaccaactagatatgttcaagtcagcaggttatttagtattttgagttatttagtaatttgagtaatgtgtaaggggtgtactgacatgctttttctctcattttctccctgttctgcctgtagcaattctaccacctttgttgacctcttcttccccccaacttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatgtcatctgggactactatcattggaaggctcagctggggctggaggctacacttccaagatggctcacttatagggctattggtgggaggcttcagttcctctccacatgaaactttcctcatgccatggaactggcttccctcagagtgaaagacccaagagagagactaagacagaagctgcaatgtttttatgacctagtcttggaagtgacttactgtcatttctactgtattttattcattagaagcaagtcattaagtccagcccacattcaaagtaagaggatttaagctgaacctcttgaaaaaatggtatcaaagtatttacggacattttaaaaactaccacaatacatataggtgaacttcacaaggtgtagacatgggctgagacagaatattggataatatctcattctgcaaacagcagcctcatctgtaataaaatcccagcattcagaaattatcacgatcaagtaggaaaagggcttgttggaaaaaacttatcaaagatgttacttcatttatccatttattctgagccatagcataatagcgacaaattgtgtgtcctgtgtaatttggatacctctgctcaataatagctgaacagattttatcctatttttagaatagttaatatatacacatggcacaaaatttaaaaggtataaaagtttctggttcaaaaataagattccctcattttctttttttctgattctttgaatgcaattcgatttactgatttctcatgtagccttagaaagtattctatgtacttacaaacatatatgtacacatattttttctttcccacaaataaaatactgtatgcattgttttattcttggctttttttcaatggacagtatatcttcaaggacttctacaatagcacatatagacctgctttatctttttttaaatgtctgtctagtactgcattatatttatttaagcagtcatctattgacagacgacattaggttgtttccagtctcttgttactatggacaaagctgcaatgactatctctgcacattcatcatttctcacacaggagtagaattcttcttcatttgtaacattgacagatattgacaaatttctctccaaaagggcttaccattttgctctcactacaatatgaatgcctgtttcttcaacccttggcagtacaataggttacccactttttgatatttgccaattaggtaggcacaaatggtctgcagttgcagttttaatttttattatctttatgaatgaggttgggcctccttttatatgcttaaaatcatctgcatttgctttactatgaattatttgttcttaatctttacccgtctttatattgagttggtgggtttttattttccttactgatgagtgggagttccttaggattaaagaaattagctcttctaaagaatcggtatacatggacagacagagtggaataataaacattggagactctgaaaggtagggataaaatactgcctactgggtacaatgtacgctatttgggtgatgggtatgctaaaaccctagacatcacctctatgcaatacatctatgtaagaaaactgcacttgtacctccaaatctatttctttttaaaagaaattagctcttcatctagagtgtgagtggcacgtattttttcaagtgtgttttttccatttgttttttgactttttattggttttctttttctttttccatgtagtaattttaaaaaatatttttctgtggtcacatttatcagtttttttctcttatagtttctgggtttgcatcattcttagaaagtcttcccactcctagggttactaagaatcctcttaaggtttcttttagtaccatcataatttgatttttacatttcaaatttgactgaattggttcttttaatgctttacactctaccgaagtataaaatactgcactgaccatgtttgttttgtttctggttcagatatttctagtttattctcagttttcttcgtttgtgaaatagagataataagtattactgagtaccatccatgacttttagtggagagatgccatcttgatgactgaaagctaaaccagagttttcttcctcattctcattacttagaaacctttgctgatgattaggtttggtgccctaatgggacaattgagactaacacggtctataagataacttgcttcaatttaaaaaggcaaaatcaaattagccatttcatatctgcctacataggggctactgctttcatttgtaatgtttaattacatttttttccccaagaatacatacacacggctatcacttctaaaataattttggctccctatgaagcagaattggaaagtgtcttaaagttagttttgaattggttatttggaattcaaaatgatacttcattaaaacaataccttaaatattggttaggttcttgagccttattacaaattccatacttatgtatttatgattcagaataggaggaatggtgctatgtcaatgacatgtaatgatatttaataacagtgtgtccctgttaatatgtgtctgagtggcatatcaggaatcccaaatatgtcttccccagtccttcccgtgcatcctagcagcagatgtgagaaccccaatagcccactgggaactggttgcaaggccagaaaggacactctggtcaggagaatacctctttatattagtaccagggaaagctgttttctaatatttggcagttgtcctgaataggataactagagaaattaggtctgtggtgtagaatttcagaggcgtatcatattttttcttggcaaataatatggttttgctgtatccccacccaaatctcatcttgaattgtagctcccacaattctcacgtgttgtgggagggacctggtgggaggtaattgaataatgggaatgggtctttcctgtgctattctcatgatagtgaataagtctcacaagatctgatggttttataaggggaagttcccctgcacacactgtctcttgcctgctgccatgtaatacgtcccttgcccttccgccatgattgtgaggcctccccagccatgtgcaaccgtgagtcaattaaacctcttttctttataaatcacccagtcttgggtatgtctttattagcagtgtgagagcagactaatacagcaaacaattagctttagggaagctggcaagcatgaaatagcgtcttagccatcaaggtgggttttaagggaagggaggtcctggagaagagaaggcagaaggcagatccccaagacaaggattcagccatacacagaaagaagatagcaatgtaggtgtctggcatgggaagcaaggtgggaattgaggctcgagaataagaaaaaatctagatatcaggactaaagtctaagactacctagaagagtgaaattatgctgagccccacactgatggtttggagataattcatctccagtgtttaaggtagggacctgggaactgggccaaagcatgggtgaaaggtgagaatgaagcgggtctgactgtggggcaaggagaggacagtggctgattatgggacagggaagatgtttaccacctctgagtggaagtttatcaccaccgagaaagtggatgaccattatttggtgaactacttatactgctgtattttgtgtatagtactaaatatatatatatatttgtttcaggattatttaatggttttgcccatgtggaaagaggcatatgcttattctatttctcaatgacatttatgagtgctataattataataacaatgatgaaagtttgactaatcaatatgtaaatagtacttatagtgagccaaatctattagaaagccagccagtctaaaagagaataaagttcccatattgcaaatacaaattatgatagtttggaataaaaatcaaattatattttgctctgtgatgcattgtgcatgctatctatgttctttgcgtctccttccatctgtcttcccgctgtttccctgctcattaacacctctactagaaagtgggcagggtgatgacaagaaataaaaatacaagttgaactgcaactaagaatttaacatttaaaaaatgccaacgtaagaatgatataaatatctcaattgtgaaaatagactgcgaccctggttagtatatggtattttaaatatgtgaaaaatgtgaggaattggagcacatcccataaaaaagaacaagttcacagaatgttatcaagggaaaggactgcagagatagactgcaggagcatctttccatacaggtgggaaatgcagaaaaattcattaaaaaaaaaaaaacgaattagcaagtacgcgtaaactctgaagacctaaacacatttctggaagctaactgcaaagcttggcctaaacatggaaatgctgaggtcacttgctggagtcaggtacggcatctgcaatggaaagatttttttttttttaaagaaggttatttcaacattttcaaaaaggaggctggggtggaaatatatgacactaggtaaatatacatcaaaatatttatatcataataggcatgtagtttatttaggctacttttattatgtttatactttacatctcaagatttctacaatgaacatgtatcaattttattatgggaaagtgggctttaaataaaaaatttatgttctgctctcatttgcttatctgtcagtggagtttcttcagtgaattttactagtcaacccgtttttacaatgggattgagacagggatcaatgctgggaatttctgacatgcaaatgattttaatgatgaaagcatggagtttagtcccaatgaggtcatgtatgcatgctgattagatttatcagactgcttctaagcaggaaggacttttaaaatttaaagattgagcgacccaacttataggaaattcagtggctcaaactatattttccaagtggtgtgataagataattagacacaattaacttgcagctagaagacaattaccaccacaaaatgttaattgtttgttctagaaattcctgcattcagtctcaaattagaagtatgtattaatatatataatattatacaaatatattattcattacatattacatgtaaaagctaattgagtattacacatattatttattagtgaatctccctgagcttcaaggaaattatagacttcaaaaaatttttgtggcctttggtacaaatgaagccgattttagaatttcacagattcttttatgaggataaataagtttttgtttatatttttgtggtacaaacctaataaagtgcccaaatcatcggcctaaacatggaacttatttcaagatgtattgattgatttaataacacaaagttgctgaagtttttaagatatattatctgaaaccaactggaaatttctgattatatttccaaatctgggcaaactttggtgaaccctatgtctgtgaaaatgcacacttgcttatgaatctgataagctttattctgagatccactgtgagtaatgcaaaactgaattcagaattgaggatgtcctgagtttaccccagaattcaccaaaatattctaatttgttaaatacaaaaactctcattgaaatggatgaaaatgatcatgattagcattaaagccgtaagtgtagattaagtagctttctgtttaatgcttctaaatagaatgcttctaatggtacacccatgttattttctattaagatatattccactcatgtttatcaataaaagctatatgtatcacacacatactgatttctgaaaattgaagtttatacaagtaaagtaattttttcaaagttacagcatggctggctagaacctaggtatgcaaaatcatacataatcagtggtcattctacgaaacaatgctacttctccctgtcgttagagaactaggagggacctttgaaggaatttgataggaactgaaagtattgtcatgtataattataagaaagaaaggttaaagtgtttcccaaaataatttttactttataaatgattgattacaaaaagattagaagataagattaattaggtttgtatgcctcttttacaatttattacttgtcattgtacaagttttaaaatttctgccttttgcttttcatttttaaaatggggataataactgtgcctgtatcacatggttgtattggtgactatgatttaataatataaaaggcttggacaatgcaatatatcagtgtagcaaaatttcatttataccccatgattatatacaaataaaaaagagaaaaataacaataataaaattaaaataaaataaaaaatagctttgcagtgaaaaataataatataaaaagcttgggacagtgtttgacacatcataagtgttcaaaaaacattagatgttattatcactatatgtcaagcactatgttttgcccttagtatacataattttaatcattccttacaacagcagtgggaggataaatattatcattcccacatggcagttttcgtaagtgaccatttttgcatggctaatatgattaaaagtcaacattcatacccagatctgtgtaagtctagaacagcaagttggtaaattaaaaactattttacattttcaaagagttgttaaaaaaatgggacagagaccatctgtagcctgcaatgcctgtaatacttactgtctgaacctttagagaacatgtttgctgactgccactctagtgcagttttttcttctgtaatatcagactaggctgcctcctgaaaaccagatgcctattttaattgataaaatcattcatgttttcatttatttgacagatatttattgagtacttgatatttgtgaggcgtgtgtcaaagtttgttcaggctgctctaacaagataccttagactaggtaatttacaaacaacggaaatttattgctcacagttctggagcccagtaagtctaagatcaaggcagcagcagatttggtgtcgggagagggttcattctctacttcatagatggtatcttcttgctgcaccctaacatagtaaaggacaaacaaacttctttgtcctctttcataaaggtactagccccatgaccgaatcacctcccaaaggccccacctcttaaaactattgccttgggaattaggtttcaacatacaattttttttgttgttgggttgggggatacaaaatttagatcatcacggcattttctagacctgtgggtaccaggtctaggaaaatgagtgagataataacatttccatcaagaaagttgcaatcctgtgaggaagtctaagagaaaatagacaatcatgggacagggtgaaaggtattttggttcaatatcacaggcttctgtggaaacacataggagggactttgaatgtagcattaaggagtcagatataccttcctggtggaactgatacttgaaataagtccgaatttttagtttaagagtaggtatagagtattctaaattactggagaagcaaataagtacaatgcaaaaagaagtatgagaatctgaaacgtagttgaagtttatggtaatggtggaacttaggaggagggtccctgttaaaagagagggtgagaaagaaagagtgcaaagtataaatatcatgcatgtcgtgctactgtttaaaatttatcctgaaggctatgaacattgtcacactgtgggattattggaaactttcagcagggaagtgacacactaaaatttacattttcgaatgatccttctggaagcatgggagatgaagaacaaggattcaagagtgaggacagggcttgcagccatggagttaaagggcctggatttaccctcatgtcttgatcaactctaacattacatgaagaagacttctcctcagacattggacaataggcagcacaagaaggactgtgaatctcgggggaagagaagtaagtgaggtgagccctgcactgcaattgcctaggattttcgcctggaggcacattttagactgcagagcagagagggagattccaagcaaggaaaagttgtcttatataattgaggaggcagaacttgaagtttaggaagtctggtgtctgtaaatggtgaggcagagatctacagagtagggagctacacagaaaacgggcttgagaaatatacacagtgggtcccatgagtctgaaaaatatcaagacaatgcacagcgtgaaatgctacaaggctgggcaaagaacaactgtggagttatgagaggagcgtatttccacaatacacacagactgcggaatcatttgcattaccaccagatagcatggagagccctcattgagcctctttacttggagaatgcagtaaagactccatccagaaggactactctgcagtagtgggctaacccattcctagaggaaaggtttctctagccctgcccaagcacaacttaaaagcaagtctcaaaaccatctaactaaatacttatattagaaaagaagtagtatcaacaatcaatgatctaaatttattagagtctaaattcccaccacaagaggctggaaaagagaagaaaagttaaaccaaagtaagcagaaggaagagaataaaaatgataacaaaaatagaaaacccaagacaaactgagaaaatttatgaaaccccaagctgggtttttgacaacatcagtaatattggtaaatatctagcaaaactgatacaggaaaaaaagggaagacaaaaaattatcagtcaagaattaaagaggggacatcattaactatcctatagattttacccagataataagggaatattagtaacaaatttataatgacaaagttggattgttgggaaaagcatcctgtggtagcagtaagtagccatccaacaaaagccactataacaataacaaaaacacatcattcattaaccaattttatgtggcaggtcctggttaaagacagtggaaagaaaccaaaaccaactaaagaagaaaagcaaggattatttattcagtgtttgctatagcaaggggagtctgccactgtcacttgtgttttgggagagaatcaaaggcaagcagaggagtgggaagcttcatagtgagaaataaagggaaggcttcaatcataccctgactggaggctgttgtcttggggaagttggaggtaggctaaccagaagcagaacatcctctgtgattgcttaggggtgcatatttggctttctctggtttgtcctaagtttggagtggggacagatattgggaaagctgtcagttatgaatcaagtcctggccattttgagccgattgttacagaagtttttgcttagcttcctatattgtttctacagatagcagcctgacttatagcaggctggcttcctggactatttattgaagttaacagattggctttctggacaagattctggaggttgatggtcaaagttctatttttatacatggattagttcatgtcagtttgtatattcagtccctcagtaataaatgatatagtgatacccaattcattctgaaagcataatgaaaagagtgacccagtcttcctgggagcatccgagaagcctttacagtgaagctaatatttgaagttgccttaaattctgaggcaaaaagaagatgagaagaaattgctaccagagatgaccacattaaaaaaaataataagcaggtgggtgggtggtgtgtttgaagattagtgaccttttaaagaagcttgaacataggcgggtggaggcagacagccaggaaagaaaggtggaaccaaaatgtaatggactttgagtgttgttctaagatgtaatcttatgggctccaagggagacaggatgctttaaagccaatagttataatattagacttgtattttaggaacatgatccttttgatagtggaaaatatgcatggggtgggtcaggaaactggaaacttgcacacaagctaggatggtattttaccaattggaggaagtggtgggaaaggccttgatttgggcagggacggtggggatacagcaaagggcagatagaacaaccagggcaacattttggacatgcagtgcgtgctccgtaaatatctgttatatttttaagtgaataaatgggacatttaggaagtggaatgggttaggtttggtgactgattggatattataaggacaggaaatagtcaagaactactaaagtttttagcttcagtgactgattgtatagcaatgctatcagccaaagtgtgaaaaataggggtgtggcagtttatgagtgaggatgccaagtttcatttggggcatgtctttagggcttataaaattggaatcagggtttgggggggtcactgatggcacataggtaatagctggaattatgcaaagaggtgggattggtcagaaagactttccaaagctaggggagagggtccagtccttgaatgcactgattctcactttttaaaattatttatttattttttttgagccagagtctcaccctgttgcccaggctggagtgtagtggtatgatttcggctcactgcaacctctgcctcccaggttcaagcaattctcatgcctcagcctcctgagtagatgggactatgggcacatgcccaactaatttttgtatttttagtagagatggggtttggccctgttggacaggttggtctcgaattcctgacctcaagtgatccacatgcctcagcctctcaaagtgctaggtttacaggcatgagccaccatgccagcctgcactgatttttaaacagtggataaaagaggaagaaacagtgtttgccattaaatactgttgtgtgctacttctttggaatttttcctttagtttcttgcacacagtttaaccattcatctacttgtatgtagggagatgaaacagaataccttttaaggaaaactatggaaatcacattgggtggaatgtacagaattcggagactctgactctttgagtcctgagctttgcgtgagggtgaatgacctgttgcacaaagggacctgagttaaaatccaagctcacctaatttctgtgaccttggccacattacttttctcagttatacactgaggttaatgatatctattttaaagagtttttaggattaaatgagataattctacataatatatgtaaagtgcccactggtgtcttgcatgtagtttgtgctcaataaatataagttgttattatttttgaagacctagaagaatgacactcaagaaaagccatcaatgcaatttttttaaataaaataaaattatggtattatttttgttgtttatattgcaaagttgatcatgtgaatttcacatttctctcttttaattctcccctacctaagaaaaaacaaaatcaattttttttctagagagggattttgaaaaagtttcaaaatagcattttcaaaatagcattttattatttctttggttcaacacgtgtttatccttatctaaaattaccctgaagattatttcctaatatggaataaatgcttctaggttacaagcatttattgggtgccttaccatgcatcagttactgtgctcaatgccagaatacaaagatgagtcaggagacttctcttgagaaattcattcattcatttactcaattaattatttatgtaactccttctaaagggcaagtgcttatctcagtggtaaaggtagagcagggatagaataaatgcacaaaaagactcggagctttggcagactgtattaaagtgaagggagacatgagagaaaataataaacaggtaaatcgagaaggtaagtttagatgttgcttagtggaaaaaaagtgaaaagaaataataggtagagattgattggaagagaacagcatgtgtggccagatggcctctggggattggggtaggattggggaggaggatgagagaaatgagtcaaaataattattataaaacaaaaatattgcataattgggagcaaaggaaattatagacatcacgcacacaaaaaaaaacagcccaaggaggaaaaagctataaatgcttaaaatatattaatttggaatcacattttaatcattttagaggttttatatgctcatgactcccactttaacctcattcttgaactaatgataatacttaaggtagggggaaaaaaagatctctttctctgttctcccaaatactcactttgggtaaacatcctgattgcaaattaacctcagtcatgttggatagaatttttgttataagtaagatttttgtgttggtcattctcccaaccaagtagatcttcattatctgtatccttgaagttctagctacggtctttaaattatccaaccagcatgtagaatcaaagtgatactgaaagtcataagactttgaaactagaaaggaccattttgtctaattcatccttaattcgcagcaggtggaatggaggctcagaaataaataacagagagtgaaaaacagtaattggcagagcaagaacagaaaccctggtttcatatcaccagattcattgattgagatctttccagtcttcccatctattcaagaaactagcacttcctaaatgccaggcactgtaaagctctgggttcctggatgagtaataagtttctctgcaagaaaacactctctcattccctagaacattgtagagtactaaaagatgtctcaattaagcaaatgataattcataacctctcaaagtacaatagacattattgaaaatgtctaattgtcacttgagagcaaatcttcgacatgcttattctttacccttttgcatcaagagttttaaaaatgatatttcaatggagaaggctttggaatgatagatttggagcttaatctagactgagacttaccaccttttgacctaggaaaagttgttgagcttcactttctagtggcaaaatgtgaccaaagttaccagcccaatgccagggactcatagaacttggtgtgttgatggaactgtccttcagttgcactgcttgaggttaggaggctgcaggaggttgggctgagaaggcccttgggcccacagtcttcaaaccccagtacacccagctcttctctacttccccaaagctctcagggccctttgcaaacaagaactcatgcaggacagtgaactctgccctacatccaagggagaaacctgaacttgggagttggaggttgcaatgaacactacatcaccggccactcctactcagcctctgtgattagttcttctcatctctgatctctgaatgctgtcatgttccagggctcaatctctgtagtgcttttcttttctgtctacattaccctttgtcatatcatccagccttctgattttaaatgccatctatacataattctgatgtatatattaactctagagttggaagtctcaactcatatttgactacctcctcttggttgtctaatagtcaattcaaaattagtaaatccagatcgagctcctgatttccctcaccaaacttcctcctgggtggtctttcccaactcactaacatggcaactccacttgttttttcagttgctaaggtcaaaaactgtattcttgatttctttttcttacatccaacattcaacctatcaggaatcttgttggttctatcttcaaaatatgttgaaacctatcttttaaccactttcaccactaagagtctggttcagcccccatcatctcctgcccagatgacgcaagagcagcggtctcagtttcagtgctcagtccctctgtttctgtattttccctcttactgtctactttcaaaagcggccagagtgatcagagtgaaatggaaatcagatgttcctcttctgcccaaagttctctactggttttctatctcactcagtgaaagccagagttcttagaatgatcccaaatgattaacagggtctgtcccataacaattctttatttttctctgctgttattctcctacccaatctctctacttcagccacactggtcacttaatttttttttttttaacattcatggaaacttctgtctcagggcttttgcacttgctgctgcttttgcctgaaatgattttccctcagaggtttgccaagctcttcttccccaccttctgagtgaggaatttcctgactatcctatctgaaattgcaaagctccctccaaccccagtaccctccaattctctttgtaactttatttttctctctatattatctgcctatgtatctatgtatctatctatctacctatcatctatctatttttctatttatctgttgtttatatttccccaataaaatatgagcaatgtttttttcctttgttttccgttttatccatttctatatccctagtgcctagagctaagtcctgatgggtgggaggtgttttgtaagtatttgtgtgataaataagtggtgttatccttaatagttgtacaatatttttttataaaaaggcattttgggccaggcgtggtggctcatgcctgtaatctcagcactttgggaggccgagatgggcggatcacgaggtcaggagatcgagaccatcctggctaacacagtgaaaccccgtctttactaaaaatacaaaaaaaaattgggcgcacgcctgtagtcccagctactcaagaggctgaggcaggagaatggcatgaacctgggaggcagagtttgcagtgagccgcaatcgcgccactgcactccagcctgggcaacagagtgagactccgtctcaaaatataaaaataaaaaaataaaaataaaaagacgttttgcttcatttttagtttatctgtttttaaataaattctaattctttagataatagtgggctttagggtcaaggataaagtgggaggatatatcaaaaccacctgcaacacaccaaaaacagaaaaaatcatagacagtgaattttgcaaatgttaaaaataaaccattctactcaaaaaggagagagagagagaagagggagagagacagagagagagagagagagagagagaaattcccaggggctagaacagagaaagtccatcagagttggggttaaagtgtcatgcccaatggcaaagaggaccaaattaggaaaaaagggactgaggtttcagtgcctgttcaggaggtggagttaagggtgtgttggccaaggtggaggaccacagtggagccaccagtggaaggctggaggtgggcaggggtgaggtgttgagttagttccaatcgatgtagaggaagaataacccatgaagggctggagcctggcccatatcacttgcatggggccccaaattgcacaattcaggtggagcagtagccttcaggttctaatttcagggtgggtttagagccctgaaacccagagaaccagactgtgcacatcaaactcatgatggtcttgcctctaggaagggtggggaagggaggtggcaaagaggactttacctacagtgtttattgaaaggaacaatacagatgtgaagaaattgttatcaattttcaattattgtgaaaatgtggattttttctgccattctaagtacttttctgtaattattttaatatcacaattattttcaaaagaaaaaaattaaagaaatagggtagtcttttaaaactaagagtatctagtctttctgtgatatttctagtgacttaggtccacttcccatatactttaactggtagtatcaggagtgattttaaaaaagagcaaatgtctattaatatatgtttttcctattttgtttgaatgataatatatgacaatctgttaaaaagtactttcttgggttaaaagtaaaaaaatgaaatctgattttttccttttgttaccttgatcaattgtgatagcactgacttagatagaatgcaaaccataggacaactcatacaattcccatcctatggcattttatagtgaaggagaattaaagtcaaaagaggcagtcaagtatctttggatatttatacgtaattgtcaagtagactttatattaagtgcatagttgtatgtgttagtgtattgctttattatttatttatttattaaattccatttttattttagatttagggggtacacgtgcaggtttgttacaagggtattttgcataatgctgaggtttgggcttctatagatcctgtcacccagatagtgaacataggatccaatagaaagtttttcagcccttgccccactctctccctccctccttttggagtccacaatggtgtctatggttcccttgcttatgtctctgtgaccccaaggtttagctcccatttataagtgagaacatgcaatgtttggttttctgtttctgcattagtttgcttaggataacagcttccagctgcatccatgctgctacaaaggacacaattttgttctttaaattaaaatttaaaacattttttaaaagaaataatccaagatgttttcttgcttagtgaaaactgctcaggtgtacatctggaatatttatttgctgtaagacttcctggaaattgctactggatataataatgtactattgatatggtttggatgtcccttccaaatctcatgttgagatgtaatcctccttggtgggtggacaggcagggggcctggtgggaggtgtttgggtcttgagagtgcatccctcatgccttggtgctgtcctcaccatagtgagtgtgttctcatgagatctggttgtttaaaagtgtgtggcttctctccccaccaccttgctcctgctttcaccatgtgaagtgcttgctcccactttcccttccaccatgaatgaaaacttcctgaggcctccccagaagcagatgctggcatcatcttaggaaggatgcagcctgcagaaccatgagccattaaacttattttcttatccagtctcaagcatttctctacaacaatgcagaacagcctaatacaactattaatccatattcatgtctataccaacagcaatactttgctgatagcaaacgggtatgtatgctaacactcctgaaaaaaaaacaccttccattttcctcaaggccaatttggaataagagaggcattgttattctgcatcattgcatcatacatcatgctttcagatatgggatttcgctcttgaaatttcaccttttaaaagaaaattctctgcttttcaaaaataaaggtattttctttggagaaataatctccactcaaaatgtaatttaaaaaaaaacatgcttttgaatcacactcttgcatccccttttcactttttgttttggctcactgcagatttgaaagctgctaaacagatcttactcaaattttccaaaacaattctttattggaaaaagattaggaatcagaaacgtaaaattatgagcccaagaatgctcttctaaattttaagaatttgatgaatctagatatttaaaataaaactccttctcttgtatacacttacttaatttttccattgtaattactcggcatttcatgtagatgcacatatagtcaaatttttatatgatctgcttggttcttacatccaatcttggcaactgtggcctgggatgaaagccaaatctgttcctaacagagtgattatccattcttccattacttattccatttagagtatgtggatatgttaatgtctgcagaacattttaagatgttcagagtaaaagagctttattaattccagatttgtgaccaaagatggggatcttttaaatggaaatggcaattgggaaatccaggacataaaagtagaaggggcattttaaccaaggagggatgagaaaggttatgagaaatagaaatagagagatgaaaatataaaaagagatctggatctaacacaatcccaggagtaacattccaggagttctaacaacaactgataatgtcttaacattgatattctcatcaatcgtaactgtgcttggaagtcatacgagacactaataatatagtactcgtgatgggcttaggttatatgccattctcttggaatttcaaagggttagaatagctttcatgaagtgagagtgaagcatgtatgcttgtcttcagaccatcacaactgagaaaaataattatattaataaaagggcttaattagaaaggagccatttgagaagaattaagtcactttgattaatataattacctttctcacagaattaatcaagatttaactttaacatataaccccagatcacttgctagaattctgtgtgtctgaaaaccaagttttgaaactcacttttcatgtagattcattatcctggtgttcccaaacttagtttatcagctggaacaactgtggagctttggccaccaccccagaccactaactcagaatccctaagatggagactgggaatttaggttgcttgcttaaccctctacatcagaggtctttaacctttttggcaccggggcccgtttgatggaaggcaatttttccacaatggggcagggagagggggatggtttcaaggtgaaacttcctgattctcagattcctgaatcctcagattatcaggcatgatttagattctcataagaagcatgcaacctagatccctcgcatgcacagttcacaatagagtttgcactcctatgggagtctaatgccactgctgatataacaggaggcagagctcaggcggtaatgaacgctcacctgccgctcacctcctactgtattgcccagttcctaacgggccacggactggcacaggtccacagccctggggttggggacctctgctctaggtgtttgggcccttgcatgatggggatgagtttcaaatatcaaaacattcagcactttgagtaacttgttaatctttggtatataacataacaataaaatctatcatttattgttgtatactatgtgccagaggataacgtgcattttctccatccacaccttaatgcttccaggcatcattattcccatttgacagatcagaagttaaatagcagagcaagtctctggtttgcctaaggttttacagttagtaaaaggcagagccaggattccggcacaattcagcctaactctggagcttgtgagcttctcagagtagcatccataggatgttatgatccttcatacaatggcctgcccatgtatatgaggtttggtgttggcatatttaataagaagagttttatatttatttccacaaagtcccaataattttcagctggtaagaattctgagttgtgagatggtaacagaattctaagcctggttgtctcacaatcctttagctgataaatgctttgagatttgcattttaattataacaaggacaaaaatatggaaaatacaaaatatattttctctcttcatatggaagggagaagaaatgtcttctcccttaggagctttgtagtaaatgaaatgtcccattcttaagcttttctctctttgccttcttcttactccccttcccacgctaggtttcagttcattcccaacagtgcaggtggctgtaggaggtacaacttggctgaggaggagaaagcccattggtaatgttctcatgttcttctgtagatagagtaagccttttccacatctaaagggctttgaaattggcaggaggattggaacctcaatcctcattcctaagtaatacttctaggtttccagcaactcatttaatttttgattcctgtgatccattcttatataaggttatctgcaaatttgatgtaatctgcattgtacttcaacaaaccacaagtcaagggtttcttactgtgagtttcctatagaaagataatgctgtgaataaaaatcctacaagaaataaaaaatcatggcaggctccgtagaagcagtgaaatatatccatcttttaaatataaacatcctaaaatgttaacgcagaaagagtaatagaaaatacgtgaatattgaaatgaaccaattacgcttgctaataaaggtagtcttgccagtttgcatcaagcttttggttctcaggaccagcctgcatgtgtgttaagagttgctttgtttatatttttatctctctgctacacgctacgcatcaagtaaacatggacaatgccttgaattagaggaatgaacatgtttttcgggcaacctggcaaccgtgctgagggagtgtatttcacattcactttctccactctcctgaagttgtcaggctaagtgcctaccagctgggtgtttacactttggggctaaggaggggaaaatgttttggcttatacacactgacaccaatggctcaaatcccagtaatttgagggacccctgttgttccgcaaattcctgcccattttctagttcacttaaaacatgctgacaattgtcttgtatgttctatcagaaaggaggactctgtcattgaagcaaaaaaccattctgtgcacaagcagagtgtgtgtgattaactcacatctttcatacaaatatgtatatataattatgtttaaatatttatggaataatgatcacatttctatgtgagagaggaacaaaaatagcaattagattgcagcttggctgtggggcatgtgtaataaagcttatcctacccttcacccctgcctccaggctatcagagcaaacttttttgttcaaactattgtatcatataaaattttaataatattttgaaagaataaagggctgtcccttctgtggcattattccacatcctgacctcatctttggtaggatttcttctttagagatatgtactctggcatcatttgaattacggagcagaacaattctactaaaatgcccaagaatacaataataaaatgtagaaattttaacttcttagagacagatgcaaatattcacttctccatgctcacagatgaaattagtaaataaatgaagagcattgatttttattttgttccttttaaagaaacttaacaactgcacaggaatgtaaagatgtatgaagatgtaattatagcacaagccagcatatgataaatactacaacaatggtacaagaacagtcataggagattacagattagggggcctctgtttctagcaacaggatagatgagatcgtctaaaaactttccacacaatacattagaaaagctggatacaattatgacaaacatctttttaaatgcacagttaataatttgtgaaaataatgtaaatttctaaatagagagaatgagaaggggatcttgaaaccaaaaagatgaccccacaccatgcataaaactgtcctgggaaaataagtcactcttagcaaactagagtcttggatttgaaatgggtgcccatgtgaccaagagccaaagcctttggcatgtgcaaagtgaagaagtatatccctgtataaagctagaattcttcaaaagctacacattagactggtgcaaaagtaatggcaaaaaccacaattgcttttgcaccaacctaatatttagccagtgaaatggtgaattaccaaaacaaacccccaaataaaaaatatagattaggaacacggaagacaagaaaatgtatttctcttcacagggggtctggatgagtgaaaatctccttcaaaaattgataactgcaggactgtccttgtagggcaatttggaaacctgaagtggagaaataggcttgctaagaccttgcaggatttagagataaagcccagaaaaacatgagttagcaataaaaaagcaagcttactctgaggaataagcaaccttgagcttgtttgctcaagcacaatttgactacaaggacttcagatactggacttattatatccaaaatttaaatatatttcaaatatataaatatgtgatgcagagatttaataacattagcaaggaaaagagtactatagatcgagtatccctcacttaaaatgcttaagaccagagtgttttggattttggattgttttcaatactgaatatttgcatatacttaatgaggtatcttgggtatggaagccaagtctaaacaaaaaattcattttagaaaattgttttatttttattgatttttttttagagacagagtctcagtctcacccaggctggagtgccacgtggcgtgatcataactcactgcagcctcaaatttctgggctcaagtaatcatcctgcttcggcctcctgagtatctgagactacaggcatgcactgccatgcctagataattaaaaaaaatttttttttgtaaaaacaggatcttgctatgttgcccaagctggtctcaaattcctgggctcaagctaacctcctacctcggtctcccaaagtactgggattataggcatcagccactgtgccctgcccatttatgttttatatataccttatacacatagtctgaagatagttttgtgtgatgtttttaataattttctgcctgaaacaaagtttaaatacttaggaatggaattttccgcttgtggcattatgttggcactcaacaagttttagattttgaagcattgtgaattttagatttttagattagggatgctcaaccagaataaaaaagactgatatatagatgtgtaagaatcaaatagatcttctagaaattaaaacaaaaatgtcgaaatgaattttccattgggtgggataaacagaaaagatacagctaaagagagaattaatgaagtataatataaatttaaatatatttcccaatatgcataggagagagacactaaaacataagaaccaaaaaaagagattaaaggacataaataataaaggatatggtgtaataaatgtctcagtagttcaaaaaataggcctttagaaaaggcagtgaagattttgattttcaattcgggaagcagaacaaatcccaataagacaaactaaaagaaatgcacacaagacacaccacattgaaatattatggtaatatatgcagactatcacagacacaagtcagattacgaacagtgagaaagattatctgcaaaagaatggcaattaggccaagagctgacttctcaataacgataatggaagccaaaagtggtccaataatactttccaaatctagagaggaaaattgtcaaactagatttttatacctagaaaaccaactttcaagatcgaaggagaaattgagacattttcaagtaaatccaaactgaaagtttatcactaatgataccttataacagatatttctctgaaagaggaaaagtaattccagaggaaaagtctgagatgcaagaatagggaacaaagaaatctctaagtttgtaggcacagctaaacaaacatgttataatatgcacaatcttggaaggttaaaaaatataagacagcatggtaggcagaataatgaacccccaaggatgtccatgtcctaattctcagaatctgcgaatgttgttatatgacaaagggaaatttatttacttatttttctctaagcagtccctcctttttcatttgcttaattaatttttttaaaatgttaataactttaggggtgcaagtggtgtttggttatatggatgaattgtatagtggtgaagttgggcttttagtgtacctatcacctgagtagtacacattgtacccaataggtcatttttcatccctgagcccatcccactctccctccgagtctccagtgtccatgataccactctgtatgcctttacatactcatagcttaactcccacttatagaagtgagagcatgcagtatttagttttctgtttctgagttaattcacttaattcgttcttttttatggctgaggagtattttatggcacatacaccatatttctttatccactcatctattgatgggcacttaggttgattttctatctttgcaattgtgaattgtgctggaattaacatgtgcactcaggtgtcttttttatataatggcttcttttcctttgggttgatacccagtggtggatttgctggatcaaatggtagatctacttttagttctttaaaaaatcttcatattgtttttcatagaagttgacctaattgaaattcccaccaggaatgtataagcattccctgacaaaggggaatttacattgcagatggaattaaggttgctgatcagctgactttaaaataaggagattattgtggattatctcctgggcccagtaagatccaaaagggtctcagaagtggaaaagagagacataaaacagagtcagttagagagagatgtgactacaggtgaagtcaaagtcaatgcaatgtgagaagtactcgaccagcaggatgaaatagaaataataaaataaggtagtataaatcattccaaaaaatcagtagtaatgataaaataaaaatatattcaactcactagttaaaaaatatagattgtcaaattgagtaaaaacatcaaaatctagctgttgctttttataagtgacatacctaaagtgtaagaacatggaaagactaatggcaaagttatagaaaaattatgcttagaaaatactaacaaagcatgtggctggtatagctagattaaaagcagatcaaacatttaaaagtaaaaatattagtagtatcaaagaggattactacataatgataagaaagtataatctaaagaaatatacaatcatttcaaactttcacatgtcttaataacatgcagtactttgaaaattcccaaagcaaatcttgacaaatttcaaagagcaattcataagtcaactgttgtacttgaaagtattaatacttcttaatgaatggcagttcaagcagaaaaattaataagtaacttgaacaatatagttaacaagcttgagataatagacctacagagaagctaaactcaaaatcacaaaacacatattattctcaattacacgttaaacatttataaagtgttaccatttatattcataaataggttgcaatagacaaaaaattatatagactcaattaccttatcaactcaaattagtaatcaataacaagaatataacttaaatgaatctattcagaaattaaagttaaaaatttataattaatttatgagttaaaaaaatcataatggaacttaggaaacagaaccgtatgcttttttagacacaatattgaaatttgtgaggcagagctagagtattaaatacttgcattaggaaagaagaaaagtgaatactaatgagataaacatacaaattaagaatttttcttaaagaacagaaaaataaaacctcagggaaagttgaaagaattaataaatgtaagaagagaaactcatttagtatgtaacaaaggagagaaacacaaagtcaaagctgttttatagagaaagctgataaaatagataaagctatagtaaatttgagcaaaagaaataaaggaaaggtacaaataaactattaagaataaaatatgcagcataactacaaaaacagaacaaatttactctttcagaattaatactaaaaacaactttgtggcaatatattttaaaaatgagaaaaaaaatcctagaaaagtatagcttacagaattgattcaagaagaaatagaagacctaaatggaactataatgaatatggcaactgacagtagttacagggcagagattattggatgcttaccaatgctatttcctcttcccggaagtacatctgccttgccattagattgaagctacaagtttggtactagtcagtggaatgagggcgaaaaagataattataggactatcctccaaaatctttctttcttaaaatctttggcttgctttcatttgcagctgaaggtaaagaaatttcatgtggtggattcctacaaaagaaaaagctgcaaaagagtcaaccaggaaaggtgctagacacacatccaatggctgctgagtgatgaatgagaaagaaaccttcggtgtagtaagccattgaaatttgggggaaatttgtaatagctgttgctgtaaacctccgcactgcaaaacacacacatcctagataattaaaagacaacttctaccagatgttgaagggcacatcattccaatcttatgtaaattattccagagaatagacaaagaggaactattcctccaacagattttaggaagccaaaataaccttaataccaacactagtggaaaacagagtaagaaaggcacaacatgatttatatgaggaaatcctaaacaaagtattagcaaattgaatccaacgaaaaatatacttgaattgtgtgcacacatacgaaatcattcttcaattaacaaatatttttaagcatctgacgtatgccaagcagcaacataacaccttgagacgtcagagatctttgcccttgtaaacctacattccagcagaagaaaatagagaatctataaataatagagacttcctagtgtcatccttgactgaggcaatctttttcttggtgctgcctaaaaacgcctttgttttttaaaaattgtatattattgatgactcatactagcttatagttaaaaggaattccccaacctttagaaaagtatataaatcattataaggaccagtttacttattatgatgtatgttgagtgttcaaaacagcaaaaaagagtaaaataataaataccacatccacccacagcttataaaagaaaactctgcccattctcctgtatatttctctgtgctgtttctttcttgccacatagggttaccactaacctacattgttttccatttttattgcacgcttatatgtatttttaagcaatagaagctattgtttacaggttttagaactttattaaatacgtttatggacagtaactaattccatttgtttaaacggtttggcataaaatagtaaataattcacagctagtaaaaccaaaaaacaaagagataacaactatttgctgcttacaaggaacaaataaaataaaaaactttaaatatttaattgaaatcacaaccatcctgatataataaacatactagctgtaagacagagtggtcatgctggacagcatcttcaagaaaccctccctgtggtttttatttgatccccataacatctattttaaatcttcttaatggctttcaataacaacttataattatatttgtaaagatcaggctcacttttttaacagattgctaagtctcatataattcattagggcaaattatattgtttccaacagttcatttttctgttgttgctggtgatttctattgatgtaatgaatttctataccgatttatatccagctatcttccaaaactctcttgtattaattctaataattattttgtagattatcttgggtttttctaaagatataattacattttctgcaaaaactaatagtcatgtttctttataatttttataaattttacttcctagtctattcttattggatgaccattacttctatttaaatgttgagcagaagcagtgcaagaaggcattcttttttttttttttttttttttgagacggagtctccctgtgtagctcaggctggagctcaggctggagggcagtggcgtcgcgatctcggctcactgcaagctccgcctcccgggttcacgccattctcctccctcagcctcctgagtagctgggactacaggcgcccgccaccacgcccagctaatgcttttttgtatttttagtagagacggggtttcaccgtgttagccaggatggtctcgatctcctgacctcgtgatccacccaccttggcctcccaaagtgctgggattacaggtgtgagccaccgcgcccggccaaggaggcattcttgtgttattccagattttaaaaagaacactgctaatagttcagttttaagtacatttgttacaaattttatcaggttaagaaattccctttattatattaccaataattgttctcatacaagttatttttatttccgctgattttacagatttggaaagtgaggcgtacacaggctaaataacttgcttaatgaaacactggtcacagagtcagaatgtgaagaacaggttgtaggactgcaaagctcttgctgggactgtggtcgtaggcttgctctccgctttgggccccactacgtgattaaaaatgaaggcttaggatatgtttacttggcaaatatcaacaggaagcagttggagcaatataaatttcagacaaagtaaaatgaagccaacagcattaaaatgagacaaagagggtcattttatgttatcaaaagttatggctcagaatggtataaattatgaattgtagcatatcatcaagctatcagacaaatacatggaaattaagagaaacaaaactctgtaggagattttaacatttctacctcaccctttaacagaattaaaataataaagaataaataatgacacaaattatttgaataccataattaatacattaatgttatatatcattttctcttggacatctcaagtattaacaccattaacaccccaaatacaatctcaataaattccccaaatcaaaaattatacatatatttctttccataaagcaataaatctagaagttaataaatttttaaacaaaatagtttgtctaagaaattttttaaaaatcactcttttaaagaactattgtgtctgggtgcagtggctcaggcctataatcccagcactttggggggccgaggtgggcggatcacttgaggccaggagttcgagaccagcctggccaacatggtgaaaccctgtctttaataaaaatacaaaacttagccaggcatagtggcggacagctgtaatcccagctactcgagaggctgaggcaggagaatcatttgaacccgagaggcagaggttgaagtgagctgagatcacaccactgcattccagcttgagcaacaagagtgaaactccatctcaaaaacaaaaaacaaaaaacaaaaaaactattgtttcaaaaatgaaataaaaactatagttggtctttcaaaaaacaatatgtttcagaacactaaaatttatagactatagatacattgtaatttaaaaaatttacaagcattagtgattttgtcattaagcaataaagaattaatatttcatgaactaaactttatattcaaaaagtttaaagaatcagcaaagctaaagagataagaaagataaagaaaagaagaacaataaattatggagaaaagcaatagagtgtatagggttaaaaactggttgtttgactctcaataaacttggtagtgatggaatgtatctcaaaataataagagctatttatgacaaacccacagacaatatactgaatgggcaaaagctggaagtattccgtttgaaaaccggcacaatacaaggataccctctctcacctctcctattcagtatagaattggaagttctggccagggcaatcaggcaagagaaagaaataaagggtatttaaataggaagagaggaagtcaatttgtctgtgtttatagatggcatgattgtatatttagaaaaccccatcatctcagagcaaaatttccttaagctgataagcaatttcagcaaagtctcaggatagaaaatcaatgtgcaaaaatcacaagcattcctgtacaccaataatagacaaacagaaagccaaatcatgagtgaatgcccattcacaattgctacagatacctgggaatccaacttacaagggatgtgaaggacctcttaatggagaactacaaactactgttcaaggaaataagagaggacacaaacaaatggaaaaacattccatgttcatggataggaagaatcaatatcatgaaaatggccatactgcccaaagtaatttatagattcaatgctatccccatcaagctaccattgactttcttcacagaattagaaaaaaactactttaaattccatatggaaccaaaaaggagcccatatagccaagacaatcctaagcaaaaagaacaaagctggaggcatcatgctacctgacttcaaactacactacaaagctacagtaaccaaaacagcgtggtaccaaaacagatatatagaccaatggaacagaacagaagcctcagaaataacaccaaacatctacaaccatctaatctttgacaaatctgacaaaaacaagcaatggggaaaggattccctatttaataaaaggtgttgggaatactggctaatggctagccagtacttcttccttgcactttatacaaaaattaactcaagatggattaaagacttaaacataagacctaaagccataaaaactctagaagaaaatctatgcaataccattcaggacataggcatgggcaaagacttcatgactaaaacaccaaaagcaatggcaacaaaagccaaaattgacaaatgggatctaattaaagtaaagggcttctgcacagcaaaagaaactatcatcagagtgaacaggcaacctacagaatgggagaaaatttttgcaatctatccacctgacagagggctaatatccagaatctatgaagaatttaaacaaatttacaagaaaaaacaactccatcaaaaagtgggtgaaggatatgaacagacacttctcaaaagaagacatttatgtggccaataaacatatgaaaaaaaactcatcaacactggtcattagagaaatgcaaatcaaaaccacaatgagataccatctcatgccagttagaatggcgatcattaaaaagtcaggaaacaacagatactggagaggacgtggagaaaaaggaatgcttttacactgttgatgggagtgtaaattagttcaaccattgtggaagacagtgtggtgattcctcaaggatctagaaccagaaataccatttgacccagcaatcccattactgggtatatacccaaatgattataaatcattctactgtaaagacatatgcacatgtatgtttattgcagcaccactcacaatagtaaagacttggaaccaacccaatgcccatcaatgatggactggataaagaaaatgtggcacatgtacaccctggaatacaatgtagccataaaaaaggatgagttcctgtcctttgcagggacatgaatgaaactggaaaccatcattctcagcaaactaacacaggaacagaaaaccaaacacagcatattctcactcataagtgggagttgaacaatgagaacacatggacacagggagtggaacatcacacaccggggcctgtcggtggggtggggagctagggaaggaattgcattaggagaaatacctaatgtagatgacgggttgatgggtgcagcaaaccaccatggcacgtgtatacctatgtaacaaacctgcacattctgcacatatatcccaatacttaaagtataacttaaaaaactggttatttgagaaaaacatgaaatagacaaatatctataaattataataaaaggaaatacaaatttacaaaatgagaattgaaaaggcaaaaagaggcacaaagtagaaatacaaaacaccaatgaaaagtggaaaatatgctcactagtaagcaaaatatagacactaaagtactgttcttcactattaatataagaaattctggctgggcatggtggcccaagcctgtcatcccagcactttaggaggctaaggtgggcagatcacgaggtcaggaggtcaagaccagcctgaacaacgtggtgaaaccccgcctctattaaaaattacaaaaattagccgggtgtggtggtgggtgcctgtaatcccagctactcaggaggctaatgcaggagaattgcttgaacctgggaggcagaggttgcagtgagtggagatcacaccatcgcactccagcctgggtgacagagcaagtctccatctcgaaaaaaaaaagaagtgtttataataatactgaattcaagatcatagtaacgtgtctgttttttacatggcagctagaagttggcacatcatttcccaaaaggtagcttttaaaaagtcacacattttgactcaatatgaatctaacccaaataaaaaattaaaatatcccaagacttttgcacaagatccaattttaattttttatttataaatgaaaattaggaataaatcattatgtacaataatagaataattgaaaattaaatgagataaaaccacatgatagaatttttagaatatgactgatgcaggaaaatgcttactaaatagtttttagtgaaggaaaaagtaggacacacctgctttttacagtatgtacagtagactcatggcatttaacattgtaacctttgattacttaacattgggtggtttgtgatggacctctgtgatctatggtgaataatatgttttcatttggagagagagcatataaaagattacagatcatttcctagtcaatgtttatatatatgtctcatacataacaacttatttgttttataaagctctataaaggcattcctaaattctttgatatgagaatactcaacagatatgagtatttgacatattttgtttttcctacagaacatcatcatccaaatccccttttcccctccctgactccaaatatttattagaacctgcagcataggagtgggtgtgctgggctggatacagaacattaggctgacagattttgactgtcagttaatgtaggagatttctgatttgatctcacaatgtcccagcaccaagttagtgaggatgtggctgcttggggttcgggtaagcgagtgtcctggtagagcatactgttttaaagctcagcaactgtagaatgaaagaatgctccgaagctaagacctcttgactcattatgactaatacatctcagagctgtatcgtaaggcaaatcagttctttataaataattaacttgggtcaacctgaggtcagagataatttgaatgctacatgactaaatgtttcctaccatctagctagtcttgctgactccttgccaaaagctgtgggagcccacctcttgtatcagcgtgatctggatgtgagacatggagtcaaaggtgatcatgttggaaatgtaaggtttaatgactgccctgttggatctaggacttgcatggggcctgtcacccctttgttttggccagtttctcccatttggaaagggtgtatttacccaatgcctgcacccccattgtgtctaggaagtaactaacttgcttttgattttacaggttcataggcagaaaggacttgccttgtctcagatgagactttggacttggacttttgggttaatgctggaatgagctaagattgtgggggactgttggaagggcatgattgtgttttgaaatgtgaggacaagagatttgggaggggccaagtggggaatgacatagtttggctctgtgtccccacccaaatctcaccttgaattttaataatccccatgtgtcaagggcaggagcaggtggaggtaattaaatcatggaggtggtttccactatgctggtctcatgataatgagtgagtctcacaagatctgatggttttataaaggacagtttgcctgcacaagctctcttgtctacagccatgtaagacatgactttactcctccttcaccttctgccatgattgtgaggcctctccaaccatgtggaactgtgagtccatgaaatccccttttctttataaatttcccagtctcaggtatttcttcatagcagtatgaaaatggactaatacgcttctcttcccacttcaggcctcacttgaatgccatttcttccaaagagcctcctttgaccccccaagagaaattgtattcccttcttatgttcaagagttttcagtttcatcactggcatctcttatacatcttcattcggacttaaatgctcatagagtgaagaaaggatggacgtattgtgtttacttaatggttcccagttagttccatcttgggaatttgaagctgggagtagatatttgatctcttgattctgcttgtttgtaagagtctacagtgttagttttctggaaggcaaccctattgtttggggcaacaaaccactaggaaacattaggactgaaagaccaggtgaacttgagattactattgctgagtaggatcatagggtacactttagtattttgcttgtgcttttcttattatcaatttaatacaagttcatttaaaaatgtagaaagaatatacaatgtaaagaggaagaaaatacctcatataccttgtatccagaagcaaccaggtcatctcttagcattttcatttcctttccagctggtataaaagattttcagtactgagagagctcttagaattcctctcaggctcactctaagtcaggactctcatcttcctgtctgttatcctttctattacttcataataccttattttaaaaaattaaggaaattacaggttggaaaagataaaccaggctggaaatatggagagtatgaaaagtggtaaagaaaaacaaaccctttaacatctattttctcagcatcacagagagttgaacttgtatagagtttgaactcccctcaattagaacctatagataaataattacaaaattcaaaatccaaacataccacagcaaatcaaagcaaactaaatcactccaacagcctgccctcccacccaccaaagtgacctataagaattatctaccaaatttatactatatcttgattattaagtccttaagttaaaattactgcagacaaatttagttactttactttcctacatttacacaatatttcatgagcttataacaaacactttgattaaaactcaatggtcaatatgttagcgattttggacaaggtaattttaaaagatgtaggataatttaaagtgattatggtaaataaacatggattatacaaaaatttatttccacagcagtagtaattatagaataaaaaattagaaatagcaaaaatatttcacaataaaagcttggttaaattcctacatttcaataaaacatgatgtcattgactgttggatagtgatatggtttggctgtgtccccacccaaatctcatcttgagttcccatgtgttgtgggagggacctggtcggaggaaattgaatcacgggggcaagtcttcccgtgctgttctagtaatagtaaataaatcttgcaagatctgatggttttaaaaagaggagtttccatgcgcaagctttcttttttgcctgctgccatccgtgtgagatgtgacttgcttctccttgccttctaccctgatcatgaggcctacccagccatgtggaactctagtcagttaaacctctttcttttgtaaattgcccagtcactagtacgtctttatcagcagtgtgaaaacaggctaatacagtacattggtaccagtagatggggtgctgctgaaaagatacccaaaaatatggaagggactttaaaactgagtaacaggcagagtttggaacagtttggggggctcagaagaagatgggaaaatgtgggaaagtttggaactccctggaaacttgttgaatggcttagacagaaatgctgatagcgatatggacaataacgtccaggctgaggtggccccagatggagatgaggaacttgttgggaactggagcaaaagtgactcttgttatgttttagcaaagagactggtggcattttgcccctgccctagagatttgtggaaatttgaacttgagacagatgatttagggtatctggtagaagaaatttctaagcagcaaagcagtcaagaggtgacttgggtgctgttaaaggcattcagttttataagggaagcagagcataaaagcatgaaaaatttgcagtctgacaatgtgacagagaagaaaatcccattttttgaggagaacttcaagctggctgcagaaatgtgcttaagtaatgaggacctgaatgtaaatccccaaaacaatgaggaaaatatctccagggcatgtcagaggtcttcacagcagcccctcccattacaggcctgaaggcctaggagggaaaagtggttctgtgggctgggcccagtgttcccatgttgtgtgcagcctaggaacttggtgccctgcttccttgccattccagccatgcctgaaaggggccaatgtagagctcaggccacaacttcagaggtgcaagccccaagccttggcagcttccatgtgatgttgagcctgtgagtgcatagaagtcaagaactgaggtttgggaatctccacctagatttcagatgtatgaaatgcctggatgtccaggcagaagtttgctgcaggggcagggccctcatggagaacttctgctagggcagtgtggaagggaaatgtttggttggaggccccacccagaatccctactggggcactgcctagtggagctgtgacacaagggccaccatcctccagaccccagaatggtagattcactgacagcttgcaccatgcacctagaaaagctgcagatactcaaccccagcccatgaaagcagccaggagggaggctgtaccctgcaaagccacaggactagagctgcccaagataggaacccacctcttacgtcagtgtgacctggatgtgagacatgaagtcaaaggagctcattctggaactttaatatttgactgccctgctggattttggactttcatggggcctgtaatcccttcgttttggcaaatttcttccatttgaaatggctgtatttacccaatgcctgtacccccattgtatctagaaagtaactaacttgcttttgattttaaagatcatagacagaagggtcttgctttgtctcagatgagactttggactgtggactttttagttaatgctgaaatgagttaagacttgggggactgttgggaaggcatgattggtttttgaaatgtgaggacatgagatttgggaggggccaggggtggaatgataaggtttggctttgtcttcactgaaatctcatcttgagttcccacatgttttgggagggaccaggtgggaggtaattgaatcataggggcaggtctttcctgttctattctcatgatagtgaatatgtctcacaagatctgatggttttaaatccctgcacaagtttttttttttttgcctgctgccatccatgtaagatgtgacttgcttctccttgccttctgccatgattgtgaagcctcccaagccacatgaaactgtaagtccattaaacctcttttgtaactttcccagtctcaggtatgtctttatcagcagcatgaaaacaagactaatacagatatcatgggactatgatcacaatatttgaactaaaaagctattgtcaaatactataagcaatattattctatttgtggaaaaatatattaacacttggaaaagagactgaaagaatattgatcaaaatctaaagcaggtttatttgtgggttatgagatctggtgacttaatatttttatttgtgctttttaatatttcccaaattttctacaatgagtatagattgttcagtagattgttctgaacataaataagacagattatctgtgtgaaaaatattagaatatttatggagaacaatctacataaacagattgtagattgtagaattattaacctagagtatttgggctcctcgaatgcccataaatgggtgtcaaagagtctgtgtaccctgtggaataatttgtatgtgtttgtatatattgttgctgatggaaggggatccacatctttcacaaaattctcaaagtgctctgtgatcctcaagacctaagcaaaagtactttgcagcaacctgttctaaatcttgtttatgacaatttaaagtcggtgtctctaggctcctcatttcaaagattgtgcatatataaactgttttggctcatgggccattcacagtgaaagcatttgggttaaagccagaatatttatgggagtaaataaaattagtatccacttgaaatgacagcagaaaaggtaagttattttttgtttgataagaactgtatcttactaccaaaactctctaatacatcctgaattattcaaaattaagactcaaattttcacattaaagttgactagtgtaatgatgtgtttctgttaaaaatcctcattatgaaatacattttgaaacattacctactgaataaacattcaactttgctttcttttgatccctacttaaatcaccatataacactgacgtcttactctgtaagtcttcacatggtctttgatcaaaagcagcgtaacctgaaaatgacctttataaatggacttacattttcctcttgtgaatggagatagagaggggctgaaagctgctctgtgcttctttgcctaacaagcctaaaaatcttatgggaaaaatgtcaacatcacccagacatttgaaaccctgaagggcattggtttgtcatttattcaaaaattaagttttctttcattttgcctttacactttcattttggataattgtgcacataaacttacacacacttctttcattcattaactgaagaattgcactctggttacaaagaccacatcataagtacttactaagttataagttaaaaagaagtggattcatttttaatttattattcaataaaattcttatttcccatttgggacagatgcagaatttgtggttcttttaaaatagcagcctgcaggcttatttctatccagagaacagtacagtccttttgagtttgaccctataaaatgttttgcttatttactttttaatttcagggttgatcgttgcagtcattacacacactggttcatggtgaacattggaagcttgcctccatattctctgaccaaagaagccacgtagtggttctcccttttaaaaaagttctttacaatcagctgcagccagtttttgattttggagaactttatctagaactgtgacattttgtggagttttatacattggaatgtcctgttcactaacccattgataggagaggggtgcgacccccttgctgcaactcactcactgcttctcatttggtgattgatcaagttctaccatatagactactgaagttttcattatgaactgtcaactcttaaggataaagagcattgttccaaaagacatctttttaagaactaggaagagtgggaagaatattagcctcctccaagtcaataataaggattcttattagaggattctgatgaggccacttacacatgtatagaaagacagggccaggtgtggtggcttacgcctgtaatcccagcactttgggaggccgaggcaggcagattacttgaggtcaggagttcaaggccagcctagtcaacatggtgaaatcccatctctactaaaaatacaaaaagtagccgggcatggtggcaggcacctataatcccagttaccagggaggctgaggcaggaaaattgctggaacccaggagacggaggttgcagtgaagccaatgtactccagcctgggcaacaagaacaaaactccgtctcaaaaaacaaaaagaaagacaaaaatcaaggatctacaacatatggaagaagaaggggttccctgaagatacatctggtaatttcactatgttttgcaggccaagacttaatagtgaaaataattcaacttttcagcttaaaaacaaaaaacaaaaaaacaattttctcctaaacatgtaactattgaaaaatctaagatacagggaatcagaagcaatgtatgagagaaggcatatgtttggttaatgtgtttcattatatgttaaatgtagttccccactactgatgttcaatagataaaaaataagcaaaatgtgtgaaataaagtgctattatagaatagtgcaaaaactttccaatggtaggctcttgtctcttttctatagacttgtgatctgtggggatgtgctctcatgctcttcattaataccctgctccaccccatcgttaaatattccagacttttctaagtaaataccatccaacaacagaatacgcatctttcattgtcacagttagctgatatctatggaacgctccacatttctccataacttcaatactgaagcatgtgcctattcgtcattctttttgccaacccagtgacttcaacactactcttggttttcttggttttccttctctggcttacccctatgatcgttacaaaaaccacggtttccatctccattccaatttagccactatgtttatagccataatttaaatctaatcatcagtcaagattactttattgctaacatcctaaattctaacatttcctttttttcttccacaaagttttgttttactgctccattcattttcttaactttactaatcaaatagttatccttcttttctacttcagttccttattgctcctctgattttccaatccagtggcactcaagctttggcatacattagaatcacttgttgaaacacaagtgtagatcgtaccctccagagtttctgattctgtaggtctgagatggggcctgaggatctgcattttaacgggttccgagtgatactgatgctgctggtatgaaaaccacactgagaaaaataatctttgttcaataaaactcttgttccattagagaaataagtgattgggaagtggaacttacaagggtggttcaacatatacaactcaatcaatgggctacatcatatcaacagaatgaaaaacaaaaaccatatgatcatttcaattgatgctgaaaaagcattctctatctcgtctgttttttatatcatccatcttttaaattttggggaacctattgggtaaaaaataatatcttactctttaaactggtatagtatttttttctatcatgactcatgtggctaagcatgtttttcatatttgttgtttgtttgcctttcatttatgtgaattgactactgaactcatttctgtttatttctttctcagtgagtgataggaatttttatacattctggttgctaattcttcatttgttattatacaacacaattttattagtctttcacttgtgtttcaaccatgaataagtattttttatatattttaattattttaatataatcaaggttatctattttttttacactaccatttttgggtttttatcctagttagcagggccttccttatcctggggtcattaacgaatattagacctcttttcttttctttctttccttcttttctttttctttctttttctttctttctcttctttctttctctctctttctttctttttcctttcttccttcctttttccttcccttctttctccttcctttctctctctctttttctctcctctctttctctctttgtttcttctttcttcttttttctttgagacagagtctcactctgtcacccacgctggagtgcagtggtgcgatcttgggtcactgcaacttctacctcctgggttcaagctattctcatgcctcaacctcccaagtagctgggattacaggcatgcgccaccatgtctgtctaaactaaatcttttcctgatgcttttaaagatttaaaaattttttgctctactttttaaactttccgaaattattttttctgtatactatgatgtaaaaaatctaattttaattttgtccttattaatagtccatcttttatttatttccagtgctacccctctcatagaccaatacccattatatgtgagtttattctatttgattggacaatttacctaatatggcaccaatgctacactattactatagctttattaaatgttttgatatctggtagaacaagttctcccatttacttatttttcacaaatttctttttttttaaatgatagcaagtttattaagaaagcagaggaataaaagaataggcaaagcagccacaaatttcttatattctcttgtaacttacttctctgtgtaacttttagaatagacttgtaaagttccacgaaaaatcttgttgagacttttgtttgatattgtgttgaattcatgcattagtttagaggaaattcacatctttaaaagtgtggattttctcacctacacacatcttaacctctccacctattccagtgttcttttatgcccatcaggaatgctgtatcattgaatccacaaagatttaaccctcttgtcattgttaaatttattcctagatacttaagatttaactgaaaaagaaaacattcctttaacgtcaatcctctctcttgatctaatcctgacactctaatttcttaaactgtccattttttgaatgacctgtttggagagtctgttttctccattttcataccacctgctatattcccttgcaatatggctttctttcctgacactgtagaaaaagtattctttaaaatgttgctgatgatacctgaattgcctaattgcataattttttctcagttttaatcattctcaatttctctgcgttacttgtcgttattgatccctgcacctatgtcaatactcctccattgctgtccatggcatttcactgtcctgttttttttttttttcctattacactctcattgcttcttatctagctttttattctcccactctgtgaacatactgttgttgtgacctctttctatatgctttcttcccatgcatttgaggatgacagggatttctatatgctcccaacaatgattttcgtgcttggcaggttatgggtggtgaataaaggtttcttgaacaaacggatcaacctaatcatagctttcaaatgcttattaacaggaaagtcaggtcactattgattattgggcaaatttgaactctgtttaccatttctgaggctacattatggtctcattttactttcagtcgtatttttctcctccactgtaatcaaactgttaactgcttcataatattgcctttgttcctgaggttttctctacctgggattccttccacttttatttgttgaactcttgtccattacttaagaactatatcatctctctccttttcttggaagtcttttctcattcttcctggtttgatgtaatctcttccacttttgaatcttcagagacactgtctgatttctgctactctcattgcatttgtattcattaataataaaaactgtctttaaaattggcacagattaaaaagaacgataattcccaatcttggcaaggtgagggaagagaaagtttcaaaaattcttgataggaatttctagagcataatttggcaacatgtgtcaaagccttaaatatgcaattagtccatggtgcagcaatttccatttccatgaatttttcctaaggaaatagtcaaagatatgtgcaatattgctcattataacatgtttttgtaaaagtaaaaaaacctgtaaaaacctgtgtccaataatctagttttggctcagcaaaccttagcatatctataatagaagacaacaaaaccaaaatcattttataaaagaatatttatttacatgggaaaatgttcacaatatgaaaaataaaacaggacatacaacaatttttctagcataatgtcattatttcagaggaaaataaatgtgcttagaaaatattagaaagacatttaaaatgctattaatggttttgtgagattgtggttgatacgaatttttttaaagttctacttttctatcttttcaaaattttcatatgtgtgcattttgtttataatttatatccaaatggactacatgatatgttgcccaggttcctcctcctctcttctctaccctcatctattaagacgtaggctctcattcacctgctgctggaggactgaaggctgacctccccgtgttgagacccagttctccaatccagcaactgcccttcactgagcaaagctgccactggagagagttgcctcttccaaggtcacatgcccttcccacaggaagtctgcatctagtgactgtagttataggactctaaactcctatcccctttaccccaatttgagagaatgctacagggccatccagcttcagatttcactctgcaattagttgtgggctttcttaaaacttcttcacgacccaccttctccctctgtctgatcatggttctttccttccccctacagctgtcaatcctgagagcccaccctagtaaacttcctacatctgctttacagggaagctcacctggaacatctgtttgcttggcactttacacttattacctcccaaaaccttgcaataggattttagggcagttattggcgtctctgtttttcagaagaagaaaactacattcaaaatgtttatgtattttatgcaaaggtacactattaataaatgtcagagccaggtttgaaagtagctgtgtttggatataaaaactatgctttttccattaagccaaatggctctctgcagtcagttgtgtgctttattatttttgtgcttttctagttctctctggtagatggtaaattcgttggctgcagggattttatcttatttgtctttgaatcccctgcagggtattgcatagtaccttacacataataagtgctccatgtttttagaattgacttgaactagttgaggcttgaaatgtagttctacttctgttccacaaaaaaacagattccctagcaggaaaagaaaatcatgatggtaagatttagaaattgttttttgatttaaatttcatgaaataatctcctaaaaaagagtgatactaattttcttctctttgcttaatattagataacaaaatgcaattttccagaactttgcttataattactaaaataaacaaatcagtgagtgtaataaacttatactgaactgtgatggcaaatactatggtttttaccttatatccctgattcagggttctctgaaatctaagtcattggagaagagaatctactaagagtagaaaaatgtaacaaggaaataagcttgctccttacacaagaattgaaagtattctaagagtcttaaagtttttgtggcagcagagatgcgtgagctgacatttccagcaatcaatggaatttgcaagtgcgagatgaattttccttaattaaaatctaccagattaatcatattttaagtacaagtaaaatgaatgtataactaattagttatgctgttaggaataaatgacattaggttcatgtttacatttagggaggcagacatttgaaagtaaactacaaagactgctgctatggtctgaatatgggtgttctcacaaatttatgcattagaacttaattcccaacatgatagtattaagagatagggcctttgggaagcaattaagtcataaaggctttgctgtcgaatgggattagtgctcttatggacagttgaagggagttgcctcaccccttccactctgtgaagacacatagaagctgctattatgagcaacaagccctccccagacactgaatctgctggctccttgatcttggacttcccagactccagaactatgagatataatttctgttgttgataaattacctagtctgggatattttgctgtagcagcctcaacagaccaagacaaacacagagtagagaaactttccatattgactgagttttattgttcttgcactccagagaatcaacatgaaaggatatgtctaacaccaaataggggttaattagttgaagttattaaagccagaaggccctggcaaatggcataacatagctacagcatgcatggttggtaactgacccaaattatgctataaaaatggtcaatgctacagcctggatattctcctagtggataaaatatgaagccacctaggtgagatgattttaggtgccaccacactgagtgggtcaaacaccatgagtcctagaattctactgttagaaatttatcactttggttgaccactttagctcctattacaatatgtatttcccagagaagctaatactcatcagttccttaacacagatatgccttttattgaaaaaaaaaaaaaacctacagaaatagaggtctggaagcaagaaatatagtttcaaaaatcaaatgggacaggccataattataattgcatatggttatgatcaatgctgaaccttaagcctgagacctaaaatcaatctagctttcagtcaacttactttagtctgtctcatcatattatttccttttatattagcctgttctagaagttctgtaaacatttccttgaaaaggtaagcaaccatctctaaggctagaagatcaatctcattgattatatttttccctgaactctagttcttccttttcagcagaaatattactgtccttagtggctcaagcctgtaatcctagcactttgggaggctgaagtgggtggatcacctgaggtcaggagttcaagagcagcatggccaacatggcaaaaccctgtctctattaaaaatacaaaaattagccaggcgtggtgttgtgcacctgtaatcccagctgctcatgaggctgagtcaggagaaacgcttgaatccgggaggcagaggttaccgtgagctgagatcatgccactgcactccagcctaggcggcagagcgagacttcatctcaaagaaaaaaaaaaaaaaagaaatattactgtcctagaagaaaacctctttaactcttatttctttcccctctattataaagtgccaataaaaaaggcttccagagcatataggtatttatattaaaacaattaaaactactgtttatctattaactccatatattttcaaaagaccactattaggttacccgcattctgtccataggcccatcctgatagaggctttccttccagttctaaggtgagattaatgtcttcttgaaaatgcttagaaattttgaagtttctgttttcagttgaaatttctcaaattgataaaccttttcaactaataattatattagtttgttttcatgctgctgataaaggcatacctgagactgggaagaaatcagaggtttaatggacttacagttccatatggctggggaggcctcataatcatggtggaaggcaaggaggagcaagtcacatcttacgcggatggcggcaggcaaagagagaggttgtgtagggaaactcccatttttaaagccatcagatctcatgagactcattcactatcatgagaacagtgaaggaaagaccttcccccataattcaatcacctcccaccgggttccttccatgacatgtgggaattgtgggagttacaattcaaggtgagatttgggtggggacacagccaaaccatatcaataatcattccttttaaaattgcaaataccatcagtaaagtcaattgtaactctttgttataatttacatttacaaatatgttgtattaatattagaaattataagttatattaatatttataaatatgtttgtttacatttattctgttacagttgactactgatggtatttgcaattttaccatttgtaacatagagtcatttgtaaattaatacaaactattttaagcctttgatttcttttaattcctaccttagggcattcactgaaagaatgagattaacttgagggaaagggagaacacagagaatggggtggtaaaaagatattgctataaaagtctttgggtagcagaaaaagactagcattggggcataggaaaagacatggggtagtgacagacaagtgtttgtatcgaaattctgccttaggtggattttgattaggatgggagagagaaagagtgagaatgagaataagaatcacacacgcgtgcgcacacacacacacgcacacacacacgcagagcaagctctttgttacttcatttctgccttctttctatcttcacccaagacaagtgtcttttttgctatgcgaggacttaaactaggcttttttaaaccgaatttgagctatactctgggctaattgattcttgcaagctagtctggcatttatggtgcctgcttttgagaaaagatgcctttgcaaatctgaacaataagcacttaggaagcctcttacaacaaattgacttataaatcaggcacacagttacagatagcgttttaacaagagaaagcacctactaaagaagtcagctgcccatcagatgatgtgaaataaatgtttcttattgagcaagtagaaaagaatggtgagctcgttcattttacagtcagaccatccccatgtggcagggtgggccaactaaagagggaaatgtgagccgttaaatatttagtaattatttggtgtataaaaactctagccatggaaatagcttatccacttaaaattgtaagtatattttgtaggaattttaatgatgtgtatgcattttgggatcaaaagatacatatagaaaataaaatgaaacaataaacacattgttcaacacactcagaaaagctacttggcaccattttaaaaaaatatatgttacgttcattttgcctttggctccttcatcttgttcccttgtcaattacctgtccctctccaaatagcccttttctctttccctattcttagaaggctcttttccctaagataattcagcactctctttcctcactcctgtatctttctagggagtatggtgtacagggtgatgtttttctctgctcaagtcattaactttgttagaagagcaccagacagagtcagtaggattcttcccttctcagtattaactaagcacctgtcaaggttatgttttcaggcaaagtttatggttggtacacagagggttagaaccttaaccatgacattatggagcacatggaacctgaaacttctgaaggaaactttccacttcagcttttggcaagaaaaataagacggagagaagagagggaattagatcatgacacatgttactcagagaaaaaaaaaagcaggaggtagtttaagaaaatggggtgaaggaaagcctaagagacaaaattctggcatcactttcctacctaggaaagtgctctcttctttcttatatctggcttctaagctaattttttaattattcttactgcctctatgttcctcaatacttcatttttaatgaaacacatgtttaaggtcattttcattatttatttttctagggagttctttctccaacttcagaactctctctaatattcttgtggttattcagtcttctttgatttttaagggattgtcaaggttcctgaagcaatgtattttcttgttcagcacagttttcagctgtgctcaatatttggattattcaaaagagagtattttgttttccttctggcgtgattcaaagtatgtagagtagtcccctcttatctgcagagtatacgtgccaagactcctgtggatgcctgaaaccacagagagtacctcactctccatcgacactatgactttttgatctgataactgagacaactactaagtgactaaccggtgtgtggtgtacatggcgtggatccactggacaaagggaggaatcatgtcccaggcaggatgcagtgagatggcatgaggtttcattacacaactcagaatggcgtgcaatggaaaaacgtatgaactgtttatttctggaattttccatttactttttcagactctggttgactgaaggtaactaaaaccacagaaagtgaaagcgcagatggggagggggaactaatgtataactatactttaataacacaaaaattaatgatgtagtatatttgctaagcaaatctggcaacaagaaggaagatggaaaacctcagcatcctgaagagtagttatttatctcagaatgaaattaaattttcaagagggtgggaaattatattccaacgataggatgaagagcagaaggagggttaatgtatgctaatattttagggaatatgagatatatgaatttgggtaagcttttttgttttccctttatcgtaggagaaaataatgttgtgtatgcattgaaaaatgcccattgaaaccatattttacgtaagatgtatacaatgctgacaaagattagtttattaatttataatgagtagaactttcatggaattacaagataaaacactatttctggtaaaaaggcagaattaagtaaagtaaaaaaattatctttacattttataaatggtcttggaattcagaaacttggtatatgtaaagtaaaagaaaaacagaactgcatgttggaaagaaattctctaatataaactgtaaaataaggaagattgttttttaaaatcctggattaaattacattttgataaaatatttgactttttcaaatgatgctggtatctgcttccatctaaagacagcatatgcttcagcttgaaacacatctatttctgttattagattctccttttaccataattgttcttgtttaaatcaccatttacctaccttttcatcacgactttaaaaattcctgtattgattcaatattatgatatgagaccttttaaagaagtatcttttttatagaaaaaaaatctgcttatttggaaaatgtgtaaaatgatggaagaggatactagttagtcatcaaaacatatttcctcttcttaattagcacacagttatgccacatttccaagtctcccttgcagtaaggtgcagccatgtgactgagttctagccagtgaaatgtaagcagaagagatatatgttatttccaggcctggctcataaaatgcaccctacatgttctctttcctgcaactttcttccttcaactgattgtggtggaaacaacaatacaaactttggaagcctcattttgagggtgtcagaacattcatcagagatataaatatttttctgtaaggtatgaggtattatacatttttagagtcgttttatataagcttagcctagagttattaataaactacctcaagataaataccaaaatacaacaatatccaattttatataataaacaatctttctgttaaaacattctctttataaatataatacaattctgttgactttgacattacttaatttcattatacttttgcctcactattaaaaccagatatcattagacttctctgataatttgtaggttgtctttctaaaattaaaccaatggtcaaagtagaattgtttccattatactgatatgaagcaataatgtaggttaagagctcagtaagaaggccagatatactgatattgaaaagcttacaggacagtctccatagcaacctcgtgcatattattttattagtttcttacaaaaaacgtatacctgaaaagtactatggaaatggtgaccccaaatgtctgactttcccaaggccacagttagaatgtaactgaacccagttagaacttgatattcttttgaaagctatgctaggaggctggataagtccacaggagaattcataatatcctgtctaattgccatatctatgcttgatttgggtaagaaaattctggaagagaacccattgacaaaaggcgtacagaacctatcaattaacactttgttaaaacctttaccttcctacataaaatcgtagacttttaaacatgaggatacatagaggccatttatttcaacatgcttgacaaaataagagctcaaaatctatctctgataagatgtagtttttctagttgtctatcttgcacatgaatatttacctgtgctaaaaagatagtccattccacttttagacaacactaattgttagaaattttaccttatgttaattgaaatctacctccctgggactttaaatgctcaaaggcaatcagattttcctttactgtagcttttttttttgtatttttttaaattttattattattatactttaagttttagggtacatgtgcacaacgtgcaggtttgttacatatgtttactgtagttttactctgctgtgcttcaaatcctttctgaccacatttgttgtacccttttcaatttgaagatgaatctccttgggagagaagaaagaagcaaaatcaaaattgagtggctttactttctctctgtcattgaataacatcttcttcaagcaggagggctatttttttcttattatccttattcgcacatagctttttaaaaagtttgctgttcccagtactcttcaataggtcaaggagtctccaaatatttgtgcacggccattattttggtatcttaagaaaataaaatgactcctctttcatcttctttgagtgatagggttattctttcaatcgcagcaaccagcaatgcttaattgtttgtttgtttgttttttaagtcacactaaacttgaacatgacctgtaactcattttagtggcatcaaattactatctcatgacaagtagtgcaaatgcatttgtgtcctatgcttaccaggcactgtaattcagcccatgctgaatgagctttaggagaaattcatatcctgaccctggtactgtctaaaaactcagtgcctttggcattcatatttatatctcttgaggatgctgatcattaggcacatgtatattttatgacttattgtaattgttgcttcaaacttttcttcacgtgctagaagcttatatatgtagcatttttccctttaattaactagatctcaaattatgttctctttacaggtcgagaacgcattcatcacaatacaagacctgggcaccatttgtattaaacttgcacttagccgtatctgatttaatttccaattcttaataggtatattagcttatatatgaaacacaaggcatgcctaaaacacaaagcatggcatatatagctttgaattgccctgatcaaatagctaatgatctgacactaattctcatatttctttttaaccatggctattttgttttccatttaatatataggaaatgaaaatttgcatttgtatctcagtagatggtttaaaattgactttcatatacatcaaatcctccccaaaccctgtaatataagcagggttggtattgctgacttcaaatcctccccaaaccgtgtgatataagcagggttggtattgctgacttctgtgtttagaaagaaaccaaagcttaaaaactgaaagataaaataaatgaacgaggactctccatcaatcctgttgaaagattttctattattataatagtaattagcactgaaataacactattttcaaggaccattctaagtgctttacatatattaactcatttcttcacaacaatctatgatgtaggttctattattgttattcttattttacagatagagaaactggggcacaaagtcacactgctattaagaactgagttttgaaccaaactattctgtctctagagtccatagccttatttcccatattttcaccttggtaaacatttatcgagaacatgatctgtgcaaaatgctttgttatgtacactgagagctataacaactaacaacatgtttgaagggataaatatgactgtaactttaaaaactgaagctatcgtaaaaatattacagaagcttaaatgttttttcccattggtatgaggtgggaagaaagagccctagtggtcaatctaggaaaccatttgaaggagatatgatttgaagctctttgcaatctgagaagacctttgcagcgtgagaaggactgtgacaggtgggcacctgggcaagagcattgcaataggacagcctacgtagaggcccagggaatgagactgtgggagtgaaaggtgagatttctcatgtggttgaagttgagggtgtaggagtgaggcaggatttagtaacagataaattacgaacatagcctcgagccagattgtggagagccttgaacactaaactgagaagatttgaattccttctatatgcagtctggacccaggaaaggtttttaaggacacgagttacataatcagataaattttagaatggcatctctggcagcaaagtataggcttaattggagagggctggactagagaaaggagaaccagaattggataaagacacaattgtccaggcaagaaagaggcaatgagtgtctgaactaagctagtgaaaatatgagtcaggagccttttaccaaagagaaacttgctcagaaataggataaactagatttggaaactcatgggaaggagaaataggaggttacctcacattttatagtctgaacagtggagaagttgcccctgtagtcacaggagacaaatatatggtcagttttggggattttgtgaaaaagcccagcccatgataatctttcttcttgaattttaacactcagctttgcacagtttggtcctctgcttgtattatgtgtatctcagtgtgtgtgtgtgtgtgtgtgtgtgtgtgtgtgtgtatgtatatatatgttatatatgtgtaatatatatgttatatatgtataatatatatgttatatattatctggcatgtatatatacacacacacatacatctcatatcagatcatctctcataatgtcagtgtgtattgtagctttgactgcctggttaacacgtgaatctactcatcgctgtatcggaaatctctctgatagcccaaatcatctcttactattttcataggtcatgctatttttcctaaaacacaagttaatctttctctcttcttgaatatttaaatattgatataaatttgaatacaattggtaggtaagatcaagggttgggtgattttgatggatgataacaatctagtgaaagtatttttagacatacgagttatgatttttttgcataattcttgcggaagaccgtgtgatagttttctgtgtgtcataaattatttcaaaccctttgcagtttcagtatgaaatatttctaatgaacaactcctttgaattatactagcaacattctatgtggctatttcagaggataatatgtctacatttttgctgtatgtttttgtactcttaaccacatttaaaccattgttaaccttggaacatcctaagatctggccctgtattttttacatcttttaaagaggtgacacaccctttataatgtgcatttttcactttttaaacctaccatttactttttaagacattttgaacgtttatttcatcctattgtgatttttaatttttctccattatcgcttacaatgtttatatataatttatgataataatgtatatttgcaatgcatataattcacctttttgccaattgatcttcattaagtcagtcaacaagagaagcttaataatgttcatgtcctttaagatgctatttaccttcatggttcagtctataaaaattgggtccaagacaaaggaacacactccagattagtcagacaatcctagcaattgttttgtcaattctattattattcatatgttgcttacttttattgagtctttctctaccctttcctttctgagccctaaaataatacttgctgccccattgacttcaggcttggcaacacagctcgtttggccaatgaaatgtaagtagacataacatgttgctctttaagcagatctttgagttattgtctgatttcctccaacttttttgtcctatctttctgtaggctagcacatcacagatagaggctgcgacttcagccttgatctcaaaataaagtgcacctggagcagaacctcagtcaatatgtacccatacaatgtagtgaaatataaacctttgtttttgtgagttactgagacttggaacttatttgttaattgcactacatttagcttaaactaatgcaaataactttctgcatattttattcttgtttggtgtagatcattgtagacattttccctacatattttctgaaaaatttagtatatttttattaaatggtatagtattataaaataattgttgtaaactttaaaaagtctttattctggttaacagtgtattgtgagcattaaaccagatgactaaatgtatacttgcctctttaatgatttaatagtgttctgtttatggaaagtggcatagtgtagtggttaagagtacagtctctgggacataaatttctgggttcaagtcactgttctaccacttactagctgtgtgaccataagatactaaatttatttgtgaccttaagtaagagacttatttatcctatgaaatagtaatccaatcccttattttgttaaataaatgactttttctattataaaaatatggtaaataatatcatgggtgccaccctctccctcatcctcacttctggcttacctcaatttctcatgagcctttattattattacttttaaataactttcataactttttaatgattgccattctaactggagtgagatggtatctcattgtggttttgatttgcatttctctaatgaccagtgatgatgagctttttttcatatgtttgttggccacataaatggaaggggaacatcacaaacccagggcctgtcggtgggtcgggggaagggggagggagagcattaggacaaataccaaatgcatacggtgcttaaaatctagatgacgggttgataggtgcagcaaaccaccacagcacatgtatacctaacctgcacgttcagcacatgcatcccagaacttaaagtaaaattttaaaaaatgtatatatataaaataccttttatattcctctttatatctagtactaccacaactactttaataaaaaatattaatactttgatctcttacctgaagtgttagtctacttttatcactcttatcatactttaatctgctctccatactgtagccagaatgacttttccaaatcgtaaacctcatcattcattcatcttcttaaaactctccaatggtttccattttctcttagaataaaggaaaaatttcttaccaagtcttaattattttcttagtctggtctctgcccctccaccttcatattttccatattccatcatgctgtctgtgctccatttctgaaaaattacaaaaaagaaaaaaaatcaaattatatatattagattaatcaggactccatagaaaaacataagcaatagtatatagagtcatgcattacttaatgatggggatatgttctgagaaaggcattgttagatggtgtccttgtttgaagatcatagagagcgcttacacaaacctagatggtatagcctactacacgcctagactatatggtatagcctattgcttctaaactataaacctgtacaacatgttactttaccaaaccctgtgggcaattgtaacacaatgctaaatagttgtatatctcaatgcagaaaaggcatagtaaaaatacaatcttataatcttatgggaccactgtcctatatgcagtctgctgctgacctaaatgtcattatgtgatgcatgactgtgtatgtgtgtatgtctgtctctgtgtgtgtgtctgtcaaaagagatttattataagaaattagaaattggctcatgcaattatgaagggtgagaagtctcaggatctgcagctggtaagctggagacccaggagaggcagtgctatagttctagtctgagtccaaaggcctgagaaccaagaaaattgatgttgtaagttccagtccaagagcaagagaagattgatgtcccagcctgatcagtgaggcagagagggcaaattttctcttaccttgccttatgttctattcaggccttcaatggattggttgaggcccacccacattgagaagggccatctgttttacttagtctacggattaaaatatatgtcttaaccagtgcttgcttcggcagcacatatacaaatatatatcttgtccagaaacaccttcacagacatgcccagaataatgcttttcatttgtttttgtttcttattatttttaatttttgcaggtacatagtaagtgtatatatttatagagcatatggaatattttgataccagcatagaatgcataataatcacatcgggtaaatggggtatccatcacctcaagcatttatcctttctttgtgttgtagacaatccaataatagttatttttaaatgtgttatttaaaaattattattgactgtagtcaccctgttgtgctatcaaatactagagcttattcattctatctaattatatttttgtacccattaaccatccccactccacccaccactctcagcctctgataaccatcattctgttctctatctccatgagtttaattgttttatttttcagctcccacaaataagtgaaaacgtgtgatgtttgtcattctgtgcctggcttatttcacttaacataatgacctccagttccatccatattgttgcaaatgacaggatttcattcttttttgtggctgagcagcactcccttgagtatatgtaccacattttcttatccattcatctgttgatggacatttaggttgcttccctatcttatgaatagtgctactgttatggatagtgctacaatctatgtgggagtgcagatatctcttcgataaactgatttcctttcttttgggtatttacccagccgcaggattgctgaatcatatggcagttttattttagtttttttgaggaacctccatacttttttccatagtggctgcactcatgtacattcccaccaacagcatctaaatgttcccttttctccacatcctcatcagcatttgttattgcctgactttgaaataaaagccattttaaaactggcatgaaatgacatctcattgtagttttgatcgcatttctctgatgatcagtgattttgagcaccttttaatgtacctgtttgccatttgtatgtcttcttttgagaattgtctattcagatctttagcccattttaaatcagattattaaactttttcctatagagttgcttgagctccttatatattttggtgattactcccttgtcagatggaaagtttgcagatattttctctcattctgtgggttgtctcttcactttgttgtttgttacatttgctgtgcagaagctttttaacttgatgtgatctcatttgtccattttttgctgtggttgcctatgcttgtggtgtattactcaagaaatctttgcccagaataatgttctggagatattcccctacattttcttgtaggaatttcatagtttgaagtctcagatttaagtctttaatccattttgatttgatttttgtatatggtgagagataggggtctagtttaattcttttgcctatggatatccagttttcccagcaccatttattaaagagaatgttctttcaccagtgtatgttcttggcatctgtgtcaaaattgggttcactgaaggtatatgaatttatttctgggttgtctattctgttccattggtctatgtgtctgactttatgccagtacaatactgttttgcttactatagctctgtagtataattggaaatcgagtaatgtgattcctccagttttgttctttttgcttacatccagaataatgtttataaaatatctgggcaccaccagacacactaaaattaatgatcacagtatactaaatttggaatataataatttatattaggtctttgtcattatagaaaaaatttactgaaatgaacaattttggaggaagtataaattaccaaataaaagcaagaagaaataggaaacaaaaatctaacaatgtccatgaagaaaaattttttaatatttcaaataattacttcaaaaactagtcctaggatttaccagtgatttatttcatgtttaagaaactgaaaatttatttgccatttgtttttagaatattaaaaattacagaaagttatataatgtgtcttataaaaccaacataaatctgaggccaaaatctgacatagagagcaaaagaggacattccaatacctgtgaggataatcagaattttctctctctctctctctctttctgtgtgtgtgtgtgtgtgtgtgtgtgtgtgtatgcctagtttgaaaaagttttttcattcaggagattcctctatatatttattatcacaattaatgtgttcctgccttgtgaacagtggtttagaaatataaatatatattcaaaacctcaaaatactaataaataagatttaaaagtattttcaggcttccacttctttctaagagtgactaataagcactggatttactgtccaacctgaaacaattgaaaaaacagaaaaaaaaaaaaaaaagaaacaatggctttcaagacactggacatcagccagtgaagaccagtgttttagtttggtagggctgctatgtcaaaataccacaaaattggtggcttaagtaacaaaaatgtgttatctcccatttctggagactagaaatccaagatcaggttgtcggcaaggttgcttcctctgaggactgtgagaaagactctgccccatgcctctcacctagcctctggtgctttgctggcaatctttggtgctcactgatttctaggagcatcactctgatctctgctttcatcttcatatgatgttctctgtatgcgtctgtctccaaatgtctcttttttttttttaaagaacatccatcatattggattagaagcccaagctacgctagcatgaccttgttttaactgaactaattagtactgcaacaatcctatttctaaataaggtcacattgtgaactataggggttagaactgcaacaaaagaatgttaggggacacaattcaacccataattgatagtgatccctgtggattgagacattaactaaagaagtcctatgatggctccaagttacttcctgaagagaatttccttctcacagagcagaaagagaaaacctaagtgaaggtcagtgatctccctgacttgagacaaagctggaagtccacgtgggccaaggtggctagagtggtcaggacagagtcttagaaaggagacagtagcagaaagaggaaactccagagcttcctctgagttttcagctgagcgccgatcaaggtatgggtgtgaggaaagtaccccaggccacagaaagaaccattctgaatgactgaaggaaacagttcttgaagatctcacagggtcaggaattgttcctcttcccatcagccagaggagaaagccttcatacatggagcactggttaaagtacctagaagtgtttttccttagtgatggggaaagattagccttaaactaaacactgctgtgaccccacctaacaatgctttaaagcagaacctaaatggctcaaacattttataagtaacttctttaaatctcagaacaaagctcaagaatatttatagaaatacagaaacatatagcacccaaagaggcaaaattgaccagatctagcatccaataaaaaaaattaccatgcatgcaaaaaagcaggagaatccaacccacaattaggagaaaaatcaattgataccaacccagaatgacactgatgataaaattagtagacaaagacattaaaacaattattataactaaattccatatattccaaaaataacaggaagatttcacatgttatacagacatgtgaaaaacctaaggatctaaattgaacttctacagtgaaaaactacaatgactaattattaaaaataacatttatgggattaatggcaaattagactttgcagaaaataagataagcagacataaatcatagaaactataaaaaatgaagcatggagagtaacaaactaaaaatatatttgaagaaataatggtccaaacttttcaattttgacaaaactattaatattctaaaagaaaacataggagatttcttaattaggacacaaaaaatgtagtccatacaagaaaaaagaaatagattggactttctaaaaattaaaaacttatgttatttgaaaggaactattaggagaatgaaaagaaaagccactgactgggagaaaatatttgcaaatcacatattggataaaggaattgtatcaagaatatataaacaccaaactgggaaaaaggtccttgcaaaccaaaaatctgataaacagttaatatctaaaatttataaagaactcttacaacctcaatagcagaaaaacaaataactcgatttaaaagtgggcaaaggacctgactagacatttctccaaagaatacataaaaatggcccgcgagtaaatgaaaaagtgtgcaacatcactaatcatgaaggaaatgcaaattaaaaccactgtgagatatcaccctgtatccttaaggatagctattatcaaaaggtcaaaagataaatgttggtgtgggtgtggagaaaaaggaaccctagtacactgataggaggaatgtagattggtacagccattatgggaaacggtatggaggttcttaaagaaatttaaaatagagcgaccatatgacccagaaatccctctctgagtatacacgaaggagatgaaatcactacctcataaagacatctgcactcccatgttcattgcagcattattcacaatagctgagatatggaaacaatctaaatggccatcaatggatgaatggataaagacaatgtgaggcatatttaccacaacatgaacggacctgggggatgttaagctaagtgaagtaagccaaacacagaaaggaaaatattgcatgatctcacttatatgtggaattaaacgaaaacagagagctcaaatacacagagatagaagatgaaacagtggctaccatggtgggcagaggagagaggaaatgggaagattataggtcaaagggtacaaaatagcagacacgtaggataaagaagtcgagatctaacgtataacataaggactaaagttaacaaaattgtattgtattaaagatttttgttaagcaagtatattttagcagctcttgtcacaaaaaagtatgtgagatggtagatatgttgacagcaaatctacatatagacaccattagctttcctagcacaaataaaaacagaactatatgatgatctcagtatatgttaaaaagcatgaaacatttaataaaagtcaaaagctattctttaatttaaaaaactcttagaaattagtaaaaagaaaaaaagaaacattaacatcagaaagactatcagacaacatattccctgctagtgaaacactaaccatctttcattaaaataagtaggacaaagatgccatcatttacaccagtactggagctaaaaggcgtccctcttggaaagatagataaatagactctgctgtttggaataccctgagttatgaataaaatggtcttcagaagctgctcagaatgccttcctgaactattccattttattcttcgtgctatcaactaagcataatgcttcctttgactatgagttgtgagtcattttccattcatgctctaaatctttggaactaataatgattttctatacatcagtaagtacacattgatttgcttctcttccccagatggggaggttgtattgagttggtccatgtaacaggagtcccatgtccctgggacagagacagaaatgcctctcggtctcctgaggctgtagttgttcggattaaaggaggaaagaaggaagtatcaggctgaatcctggctaaggatggaatcctgggaagcatgactgagtgttctttacatctgggaaggcctggagttgttctttcaactaggaagagccaggtgaaagagataagagggatgatcactaaaggaatgttgtttgctcagatggaatctaatccaaggccaattatttgagcaaaacagttccaaattcactcagaaagcttcctgttataacacgtttacattcatctcaggtatgctcagggttcataagttcattgcttatccatattaaaatattgcagggagtgtgagtgaccaccagaaaagttaactaaaggaatatatcagctactctgatggacaatttgaaaacaagaagaaaaatatgcactattaatcaatgttttcagaagtatctaatttagtctggcagcagaacaagggaattcaaaagaaaaatggaattttgttggagggggtcaaagtagaaatgtttcttaagtgttacagtgtgaaaacagagaaatgttaaacttgatgctgtcatacaaataactttgacctcaaaaagccagaaactttgaagaaatcttgatgagtcctacagattctatcatcacctacatatagatctcgatgccaaatctcaaggcagggtacccagcagagagcttctgggacatgtgtccactggggctgcagcaaagtttgtgttacataacactgctggggagattaagcacacagcgaggagggtagcagaactgtagtcactgctgtgaatactctccattaatcaatcgatcaacccacaggtagatcccgagcacctcacctgtgtacaggaaccagacttgcacaagttcgccaaagtgtttcacagaaaaacctaaaaccagctttggcttatgagtttggacagcaaagggcgagaaaaagaaaattgttgggaagaggcagagttaccaatagaaataattaccccagcctctaacagaaaaataacccttatatgcaacttgtgtaggaagtatttaggattcaatattgtaaatagaaatcaccatgtaaattcaaatgcaaagaaaaatattaatttattttattatacaatcgggtcattctacatgtgcaagacacaacgcagttttatactctgtataatttttttttttgagatggagtctcgctgtgtcacccaggctggagtgcagtggtgcaatcttggctcactgcaagctccgcctcccaggttcacgccattctcctgcctcagcctcctgagtagctgggaccacaggcgcctgccaccacgcctggctaattttttgtattttagtagagatggggtttcaccgtattaaccaggatggtctcgatctcctgacctcgtgatctgcccggctcggcctcccaaagtgacaaatatttttaaagacctagaatttggcctgactttctgtataatgtgatattttctagctctgtctttaaatggaattaaacttcttagggatgtttgatttagctctgagcagatttgttataactctgaggattttttctagctgatttttcttaagttctcatgttgagggttcctgtgaactcaaaggcccaaactctgttcaaatacacaccaagggaaatcttgccactgatgacacagtaagtaaaaggtgccaagggagagattctggctaagactatttcttctgtgagagaggacagagtctgtgtcagttatgatggcaactgttggataaaaagcaacacttttacaacagaaatctttttttaaacaatcaaatgtcatggctgcctgcactttctgtatgtgttgtgagcagtcatctaattccaaaacagccctaagcgtatgtcaaatcagtctacaagtttcctacctgtcttcattaggtttttctgatttgtctttgaatttgctggaaactcaatatgggaaagaaattgtgtaggacatcttttaattttttattccttggctcacaccctctgtcactgcagccaccacttttactcaggtgaggcttgacagtcccttgtctcagctgcacagagcatctcttttttccaaccttggggttcctctgccactatctgtgtgtctcctgtaaacttgctatgatggttaatactgcgtgtcaacttgattggactgaaggatacaaagtattgatcctaggtgtgtctgtgagggtgttgccaaaggagattaacatttgagtcagtgggctcggaaaggcagacccaaccttaacccgtgtggtcacgatctaatcagctgccagtccagctagaatataaacaggcagaaaaatgtgaaaggaaagactggcctagccccccagcctatgtccttctcccatgctggatgcttcctgccctcgaacatcggactccaagttcgtcagtttgggaactcggactggctcttcttgctcttcagcctgcagacggcctattgtgggaccttgtgattgtgtgagttaatacttaataaactcccatatatatatatgtgtgtgtgtgtgtatacacatatatatacatacacatacacatatattatatatatatatgtattgcattggttctgtaccgctagagaaccctgacttgcccagacattctcacacaggtgcaaaatggaagggcaaagacatacttaacatacttggatgggtgaccattgactaatgtaggacagtaactgattgataaattttcctctcttgagaactccttgtctcaggcaggcagttctgtggctttgtctgcatgcttccttagagtttacaggcagagctgtgttcaacatttgtagccttggagtggttttccttccttctctgtctcaaacttcccttctctcacttctattccctgggatttcttcccaaaataaactacctgtacatacacaaggtctcttctcaggttctgcttttaggggaattaagagagcaactaagtattttagtagctatttggttgttttaatatgcctttgtgacaaaccagtaggtcatacaagtatgacctactggtttgtcgatggctcggtacagtggctcactcctgtaatcctagcatatttcaagatggctattcagagggctggaaatacaagaatggctgaaaagcgttcacagacagcaacaaacaggagttgtgggtgtttccaacaaaaaaacaaacttgggttacttgaagccactaaatttgtggtaatctgtttcagcagcaataggagactaatacaccagcctggccccagtccccagatgatacacacggctgttggctagtagaattccagtggtattttatgtttttaacagttttgaaaagcatgttttttatatgaagcatcttttccaccctgtttcctccacatctcaaatgtccttgtccaattaaatgcaagctgtcataataaagaaaaacagtttgaaatctttaagattcccagtcaaaagagagactcataattatatataagtgaatgcagaatctattctaatggaaagatttggagatttcatacacacatgcacatacatatctatgtatacacatacaaatcaatatatattccagtacatgtagtacatattagagaatacgaacatatatgcatatgcatgctttagtttgtatgtgtatatgtgtatatatatgtatatttgtgtacatctatttgtatatctgtatctatatatcttcaactaagaggaaaaaagccaagccaaagataatcaacttccatatagcgccatgctaccaataactttttttcaaatactatttctagaaggcaatttgtcagtacctattaaatatgaaaatgtgtacctcttctggcctaacaattcactgttcaggaatttaatctaaagaaatactttaaaaaatgtgtaaagatatatgtatatatttaatattaattgcagtatgttgttttctaaaaaataaaatgaaacatatctgtcattatttaaataggttttagtttattcattaaatgcaaagagtgagattaggatgtatgggcaccaaagcatatccatgaaatattgggtgaaaaaaggaagttttagattaaaatatagaagataaaccataaaaatacatgcattttgatgtaaaggttttcttaggagcataattactttaaatatatatatatttaaaacacaaagagatggtgctatcatcaagatcagaagacaaaaaaacttaagtcagtggattttagtttccatttccagagttaaagtcatatacatgctgtactctatttctctgtatgtatgtttttttctctctcttttctaaaggagagaaaatatagatctttttgcattgtggagtttgggaaacggttaagtctctgagtacttctgagcattttaatctgttgatctcaccaaaggtcatcaattaatgctttttatttataaataacttctgttctttgtttttgagctcaaaatttaagaataaaatcaaacttttttgaggaggttgggattcaaagtgttaaggacttttactaagtaaatgattatttgtttctttttccattttaagtgagtttccatttataggtgaattacttccttatgcaagccagcttttaaagcaactatttaaacgaaaatagataaataaaatttttgaattttttttccagaaagaaaagaggaaacatgaatggagttatactgtgtgccagcctttgtcctagtgacttaaaaatggtataacatttaatgttcatgaatgcctattgagctggaatcatttcttagatctttccgaggagacacagggtccatgaagcacagggtcactttgccacacattcatttttttaattttaattaattaattaattaattaattaattaattaattttgaggcagagtttcactctgttgcccaggctggagtgcagcggtgtgatctcggctcactgaaacctctacctcccaggttcaagcgattctcctgccccagcctcctgagcagctgggactacaggcacctggcaccacactcaggtaaacattcagacatagaactcattactcttttctgtaacatggaacataaaatattctatggttttatgtaggctattagtggaattatttttcttaagcctatgttggctaaacccgatcacttatcttgggcaagtcctgttggtaatgtactaacacagaaagtgcagctatttagaacatctaaaatgataacttatgaaactgtattgctctaaaaaagaagaggataatttaaaatgtataccttgaacatttttctcttgaagactattattagacatttaatcttagatgctaggagattagagctttctatatctttttgccaaatctatatctgtcaaaatctgactttaggcatataccattaacataaattgatatttttggacaaagcttacattataacagatctttctaatactaagtaagcctccagatattttgctgtttagtttggatcttacatttgttctgtagttggataaatacatacctgaaatttagcaaggagtatgtaaacacttgataatattattagtgtgatatgaataatagcattgctccttctgtaagaactaaatgcccacatttatcagagttactacctaatattagagctagaatcacctaaagagattaaacaacaggagaaaaaaaccctgctctcaaggatttcacagtttggtgggagaaaaccttttccattaaaacagcaccctacttcagtgcctagtatatgctaggtgttattggggttaccttcaaatttgctcatttggtcttcataataacctgcctttggagggggattttcctcccccaagaatgtgcttgctttttggtcctttggaaactcctattcatccttcagaatttgttgagatagcttctttatgaattcttttggccaggtgctgtgactcgctcctgtaatctcagctactggggaggctgagatgggacgatcatttgagcccaggcatttgagaccagcctgagccacatagcaagaccctgcctctaaaaaagtaaaataaaataaatgaattctaccttggcctgcctcctctcagctgtcccctataggattaatcttcccatctcttaatgatttctgcatatatttctataacagaaatcaccttgagctgaaatttcatggttatctctctgtgacacaacagtgagatcctttgaggaagaggattttgtcctattttgctcattcaagtcaaccccaacactgttctactggatgatccattcaaatcttgaaaggcgaacgtctccccctcacggacagtaccggaattcaacaagtgaaagttcaattttattctaggaagcttctctagtgaggcagatttgccagtgtctgtatctttgtcaatcttcacggcaatcttctgaagtcatccctttgctttcttgcatcctccactagacagttgggtgagagatgactcttatttgattctctctctatctaaatagtaactgaagcctgtggacagtctataagtgtttaccaaaataaatcctccttaccctactccattttttaaaaatcaactttatttaggcataatctacatacaataaaatccacacatttcacacgcaccggttgatgactcaataaatatatacttctgtacattcattactcaaatcaaaatataaaatacttccatttccccaggaaattccctcatgcccttttgtagttaatctcccccattcagctgccactccagagatgagaatctccttttgttgcagtagtatagttttgcctattctacatattcatgaaaaattgaatctcatgatatgtactcttttgtgtctggcttcttttattcaattcgatgtctgtgaggttcatctatgttttgcaaaaggaagtaatgtattcttttttactgctgaatagtattttactgtctgaatatatgacagtttctttaaccattcacccattaatgacatttgaattgtacccagcttggctactatgaacaaagatgccatgagtattcatgtacaagttgttgttttttgtttgtgtttgtgtttgtttttgttttgttttgttttgtttttttagatggagtttctctctttgttgcccaagctggagtgcagtggcatgatctcggatcttggctcactacaacctctgcctcccgggttcaagtgattctcctgtatcagcttcccaagtagctgggattacaggtgcctaccaccacgcctggctaatttttgtatttttagtagagatggggtttcaccatgtcagccagggtggtctctaactcctaacctcaggtgatccacctgccttggcctcccaaagtgctgggattacaggcgtgagccactgcacctgacctcatgtacaagttttttaaaaatggatatttgtaacttttctcttgggcaaatacctgccagttagtaacttaatatggtaactatatgtttaattttatatgaatatgaaactgcaacgtgttttaaacatatctgcagtattttacactcccatcagcaatgtagaagtttcagaagctcactgtcagtcctttttcccactgctgataaagacatacctgagactgggaagaaaaagaggtttaattggacttacagttacacatggctggggaggcctcagagtcatggcgggaggtgaaaggtgcttcttacatgatggtggcaagagaaaatgaggaagatgcaaaagcagaaacccctgataaacccatcagatctcatgagacttattcactaccatgaggacagcatgggggaagccgcccacatgattcaaattatctcccacctggtccttcccacaacacatgggaattatgggagtataattcaaaatgagatttgggtggggacacagagccaaaccatatcattccacccctggcccctccaaatctcttattgtcacattttgaaaccaattataccttcccaacagtccctcaaagtctaaactcaattcagcagtaacccaaaagtccacagtccaaagcctcgtctgggacaaggcaagtcccttccacctatgagcctgtaacatcaaaagcaagctagttacttcctagatacaatgggggtacaggtaatgggtaaatacagccatcctaaatggtagaaattggccaaaacaaagggattacaggctccatgcaagtccaaaatccagcagggcagtcaaattctaaagctccaaaatgatatcctttgattccatgtctcacatccaagtcacgctgatgcaagaggtagattcccatagtcttgggaatctccacccctgaagctttgcagagtataacgcccctcctggctgctttcatgtgctggcattgagtgtctgcagcttttccaggcacatggcacaagctgttggtggatctacgattctggggtctggaggacagtggccctcttctcacagctccactagacagtaccccagtagggaatctgtgtaggggctctgatcccacatttccctccaacattgccctagcagagttctccatgagggccctactcttgcagcaaacttttgcctgggcatccaggtgtttccatacatcttctgaaatctaggtggagtttcccaaacctcaattcttgacttctgtgcactcgcaggcacagtaccacgtagaagctgccaaggcttggggcttgcaccctctgaaaccatgggccaagctgtaccttggtctcttttagcaatggctggagtagctgggacacatggcaccaagtccctaggctgcacaccacatgaggaccctgggcctggtccatgaaaccattttttcctcctaggcttccaggtctgtgatgggaggggctgccatgaagacctatgacatgccctggagacattttctccattgtcttggtgattaacatccttgttacttatgtaaatttctgcagccagcttgaatttctcctcaaaaaattggtctttttcttttcttttctgctccattgtcaggctgcaaattttccaaacttttgtgctctgttttaaaatggaatgcttttatcagcacccaagtcacctcttgaatgctttgctgcttagaaatttcttctgccagataccctaaatcatctctctcaagttcaaagttccacaaatctctagggcaggggcaaaatactaagagtctctttgtaaaacataacaagagttacctttcctccaattcccaacaagttcctcatctccatctgagaccacctcagcctggaccttatcattaatatcactatcagcatttctgttaaagccattcaataaatctctaggaggttccaagctttcccacattttcctgttttcttatgagccctccaaactgttccaaactctgcctgttacccagttccaaagttgcttccacattttcagatatcttttcagcaacactccactctactgttaccaatttactgtattaatccattttcacactgctgataaagatatacataagactgggaagaaaaaggggtttaattgaacttacaattccacatggctggggaggcctcagagtcatggcggaaggtgaaaggcacttcttacgtggtggcggcaaaagaaaatgaggaagatgcaaaagcagaaacccctgataaacccatcagatctcgtatgacttattcactaccatgagaacagtatggggaaatggcccccatgattcaactatctcccactgggtccctcccacaacccatgagaattatgggagtacaattcaagatgagatttgggtggggacatagggccaaaccatatcattcactaaaagtttggtattattaggctttctaattttaaccattctagtgggagtatagtggtatctcattgtggtttttagttttccctaatatctaatgatgttgagcatctttttatgtattactagccatttatgtatattcttttgtctattttaaaattgggttgtcttattattgagttgtaatagttctttatttattcatcgtatatatgtgtctttaatcatatatatgtgttccaatattttctcttttatttcatacatgtgttttatcatatacatgtattccaatgttttctcctagtcaacagctggctttttattttttgacagtgtctttgaagaccagaaagtttttattttaaaaaagttcaatttttcctttatgattagtattgtttgtgtcttatctaaaaaaaaactctgcatatatcaagattaaaagattttttttgttttcctctagaagtgttatagttttagctttaataatcaggtttattattacattttaaattaattgttttgcatggtgttagataagcattatgttttatttttcttcttcttctttttttttttttttgagatggagtctcactttgtcacccaggctggagtgcagtggcgcaatctcagctcattgcaagctccgcctcccaggttcatgccattctcctgcctcccaggtttacaccattctcctgcctcagcctcccaccattctcctgcctcagcctcccaagcagttgggactacaggcacctgccaccatgcccggctacttttttttttcttgtatttttggcagagatggggtttcaccatgctagcaagaatgggctcgatctcttgaccttgtgatccacctgcctcagcctccattacaggcatgagccactgcgcctgaccttattattcttcttatacaaatatccagttgcttcaatatcatttattgaaagaagtatcctttccttatgagattgcattgctgcccatgcaaattatcaattggccattatgtgtgagtctacttcaggactttctattccattgatctatgtgcttatatttaactttaccacactgtgttgattaatgtacttttttactacacattgaaactgccaactttgttttctttttcaaaattatttctctgttctggtccttcacatttccaagtaaatttttgaattattatgtcaatttttacaaaagtcttctggaaatttgaccagaattaagttaaatttgtagatcaacctagggagaataaacatcttaacaatatcaggtcttctaatccatgaacaaggtagacctctctcaatttacttatatcttctttagtttctatccatagtgttttatggttttcagttttctctgaatctatcatgatatatcattttcccccatttttctcttaatatgatgaatacattgaatttcttttgctagcctcatcttgctttcttggtataaagcttactaagttatgatgtattatgatttttacatattatgggatttaatttgctaaaattttgttaaggatttttgcttcaagactcataagggactttaatctgtaatttcatctcttgtgctatttatgtctggttttgatattagaaccttgtaaaatgagttctgaaacgttctgtccttgtcttgtttctgaaaatgtttgtataggattgctaccaactcttccataatgtcttgagttatgattgagttagcaaatgaaaaaatctgtgcctttaagtttcatcattatgataggacttactacaaattcagtttctgaataggctttctattttctcttgtaacttttgattatttagaatttttttaatttttttaatttattattattatactttaagttttagggtacatgtacacaatgtacaggttagttacgtatgtatacatgtgccatgctggtatgctgcacccaccaactcgtcatctagcgttaggtatatctcccaatgctattcctccccctccccccatcccacaacagtccccagagtgtgatgttccccttcctgtgtccatgtgttctcattgttcaattcccatctatgagtgagaacatgcagtgtttggttttttgttcttgggatagtttactgagaatgatgatttccaatttcatccatgtccctacaaaggacacgaactcatcattttttatggctgcgtagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccattctaagtggtgtgagacggtatctcattgtggttttgatttgcatttctctgatggccagtgatgctgagcattttttcatgtgttttttggctgcataaatgtcttcttttgagaagtgtctgttcatgtccgtcgcccactttttgatggggttgtttttttcttgtaaatttgtttgagttcattgtagattctggatatcagccctttgtcagatgagtaggttgcaaaaattttctcccattttgtaggttgcctgttcactctgatggcagtttcttttgctgtgcagaagctctttagtttaattagatcccatttgtcagttttggctcttgttgccattgcttttggtgttttagacatgaagtccttacccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcgtgtttgtcaaagatcagatagttgtagatatgcagcgttatttctgagggctctgttctgttccattgatctatatctctgttttggtaccagtaccatgctgttttggtaccagtaccatgctgttttggttactgtagccttgtagtatagtttgaagtcaggtaatgtgatggctccagctttgttcttttggcttagggttgacttggcgatgcgggctcttttttggtcccatatgaactttaaagtagttttttccaattctatgaagaaagtcattggtagcttgatggggatggcattgaatctataaattaccttgggcagtatggccattttcacgatattgattcttcctacccatgagcatggaatgttcttccatttgtttgtatcctcctttatttccttgagcagtggtttgtagttctccttgaagaggtccttcacatcccttgtaagttggattcctaggtattttattctctttgaaacaattgtgaatgggagttcactcattatttggctctctgtttgtctgttattggtgtataagaatgcttgtgatttttgtacattgattttgtatcctgagactttgctgaagttgcttatcagcttaaggagattttggctgagacagtggggttttctagatatacaatcatgtcatctgcaaagagggacaatttgacttccccttttcctaattgaatgccctttatttccttctcctgcctaattgccctggccagaacttccaacactatgttgaataggagtggtgagagagggcatccctgtcttatgccagttttcaaagggaatgcttccagtttttgcccattcagtatgatattggctgtgggtctgtcatagatagctcttattattttgaaatacgtcccatcaatacctaatgtattgagagtttttagcatgaagcattgttgaattttgtcaaaggccttttctgcatctattgagataatcatgtggtttttgtctttggttcggtttatatgctggattacattcattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagattctgttattggtctattcagagattcaacttcttcctggtttagtcttgggagagtgtatgtgtcgaggaatttgtgcatttcttctagattttctagtttatttgcgtagaggtgtttatagtattctccgatggtagtttgtatttctgtgggatcggtggtgatatcccctttatcattttttgttgcatctatttgattcttctctctttttttctttattagtcttgctagtggtctatcaattttgttgatcctttcaaaaaaccagctcctggattcattaattttttgaaggatttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttctttatgtacccagtagtcattcaggagcaggttgttcagtttccatgtagttgagtggttttgagtgagattcttaatcctaagttctagtttgattgcactgtggtctgagagataatttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcacagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgagtctgggtgctcctgtattgggtgcatatatatttaggatagttagctcttcttgttgaattgatccctttaccattatgtaatggccttttttgtctcttttgatctttgttggtttcaagtctgttttatcagagactaggattgcaacccctgtctttttttgtattccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctctttagttgatgcagtttcttcctagtctcgatggtctttacgttttggcatgattttgcagcggctggtaccggttgttcctttccatgtttagcacttccttcaggagctcttgtagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagagtttctgccgagagatccactgttagtctgatgggcttcgctttgtgggtaacccgacctttctctctggctgcccttaacattttttccttcatttcaactttggtaaatctgacaattatgtgtcttggagttgctcttcttgaggagtatctttgtggcgttctctgtatttcctgaatctgaatgttggcctgccttgctagattggggaagttctcctggataatatcctgcagagtgttttccagcttggttccattctgcccgtcactttcaggtacaccaatcagatgtagatttggtcttttcacatagtcccatatttcttggaggctttgctcatttctttttattcttttttctctaaacttcccttcttgcttcacttcattcatttcatcttccatcgctgataccgtttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggcttgaatgtcctcccgtagcttggagtaatttgattgtctgaagccttctctcagcacgtcaaagtcattctccgcccagctttgttccattgctggtgaggaactgctttcctttggaggaggagaggtgctctgctttttagagtttccagtttttctgctctgttttttccccatctttgtggttttatctacttttggtctttgatgatggtgatgtacagatgggtttttggtgtggatgtcctttctatttgttagttttccttctaacagacaggactctcagctgcaggtctgttggagtaccctgccgtgtgaggtgtcagtgtgcccctgctggggggtgcctcccagttaggctgcttgggggtcaggggtcagggacccacttgaggaggcagtctgcccattctcagatctccagctgcgtgctgggagaaccactgctctattcaaagctgtcagacagggacatttaagtctgcagagtttactgctgtctttttgtttgtctgtgccctgtccccagaggtggagcctacagaggcaggcaggcctccttgagctgtggtgggctccacccagttcgagcttcccagctgctttgtttacctaagcaagcctgggcaatggcgggcgctcctcccccagcctcgctgccaccttgctgtttgatctcagactgctgtggtagcaatcagtgagactccgtgggcgtaggaccctcccagccaggtgcgggatataatctcgtggtgtgccgttttttaagccggtcggaaaagcgcagtattcgggtgggagtgacccgattttccaggtgcgtccatcacccctttctttgactcggaaagggaactccctgaccccttgcgcttcccaagtgaggcaatgccttgccctgcttcagctcgcacacggtgcgcgcgcccactgacctgcgcccactgtctggcactccctagtgagatgaacccggtacctcagatggaaatgcagaaatcacccgtcttctgcgtcactcactctgggagctgtagaccggagctgttcctattcggccatgttggctcctcccgattatttataaatttttaaaaatttatacattttatctaagttgtcaaatttatttacataaagttcacaatgtttccttattattttaagattggtgagattagtagtgtccttttatttctgatattggtatgtgatttttatctctcattttcttggttactcttattgtgtcatttttttcaaaacactaactatggctttattttatgtattgtttatctgtcttctattttactgatttctgcttttatctttattatttgtttcttctacttatgttcagtttaccatttactttccatttacttgtttgcttcttaaagttaaatattaaatcattaattttgacctttcttccttaatatagacaatgatgtctgaaaaataccttctaagccatgctttataagcatcccagaaacttaaacacattgtgtttttattattattcagctcaaaatacttctttatttctcttgcaacttctttaatccagtgtgtgttatacaaagtccaaatatttgaggctttctgccatattttactgatgtctaattcaatttctttgcaggcagtggacataatctgaaatcattcaataaaatgtactgagatttatttcatgggccaatgtatgatttattatttcaggtgtaattttgagtttttggatgtaaggcctgtaatgtgcattagatacagttgactgagaagatagtttagatattatattttcttactaatttttgtctacttatcttgagaggtttttaaaatctctctacataaatgtggatttgactatttatatttttatttctgtccattttacctcatgaatttgactctttgttattagttgcatatatatttagaattgttatgccttattggtgaatggctgcttttatcattgtgtatacttaaagtctgcttcacctgatattaatatagctcctccaccttccttatgtttactctttgtatagtgtagctttcctacctgtttatttctaacctacctctgcctttattttaaaaatacaccttttacatggcacattagggttttgtttctttgattttaaattttttatttttgatttttgttggtacatagtaggtgtgtatatttatggggtacatgagatgttttgatacaggcatgcaatgtgaaataagtacatcgtggacaatgaggtatccatccacaaatcctcaagcatttatcctttgtgttacaaacaatccaattacactcttttagtcatttttaaatgtatgattaaattatcattgactatagtcaccctattctgccatcaaacagtatgtcttactcattctttctatttttttgtacccattaaccatccccgtctcaccttcattccccaccacccttctcagcctctggtaaccatccttctactctctatttccattagttcaattgttttgatttttagatcccacaaataagtgagaacatgtgatgtttatctttctgtacctggcttatttcacttaaccatctccagttccatccatgttgttgcaaatgacaggatttcattcttctttatggctgaatcagactccactgtgtatatgtaccacattttctttatccattcatctgttgatggacatttacgttgcttccatatcttagctattgtgaatagtgctacaatctacattttctttatccattatctgttgatggacccttagattacttccaaatcttagctattgtaaacagtgctgcaacaaacatgggagtgcagatatctcttcgatatactgatttccattcttttgggtatatatacccagcagtgggattgctggatcatatagtagctccatttttatctttttgaggaatctccaaactgttttccatagtggttgtactaatttacattcccatcaagagagtataaggtttcccttttctccacattctcaccagcatttgttattgcctgtattttgggtataagccattttaactgagatgagatgatgtttcattgtagtttttgatttgcatttctctgatgatcaatgatgttgagcacttttcatatgcctgtttgccacttgtatgtcttcttttgagaaatgtctactcaaatcttttgcccatttatggattcaattattagactttttcctatagagttgtttgagctccttatatatctggttattaattccttgtcagatggatagtttgcaaatattttctccaatcctctgggttgtctcttcactttgttggttatttcctttgctgttcagaagctttttaactccttgtgaaccaatttgtttatttgtgtttttgttgcctatggttgggagatactgctcaagaaatttttggccagaccaatgtcctggagatttcccccaatgttttcttgtagtagtttcatagtctgaggtcttagatttaagtccttaatctagtttgatttgattttttacatatggcaagagacaggagtctgctttctttcttctgcatgtgaatatctagttttcccagcatctattgaagagactttattttaccccagcatatatttttggcaccttttttttttggtccagtatgaaaatctctgtcagttgatgggtattagtttatttacttttaacataattgctgatatggctgaattcctatcttgctcctaacataccttcttttcggtttatcaacattttttaatactcagtttttacttgctctagtagtttcctaactatacctcttttattgtattttaattggtttctctatggctaactgtatgcatccttaacttaccagaattaatttagaattaatattgtaccttttaaaacttcaacatataacacaatacgtttgactttaacctttctactttccacttcccaatatatactttccacttcacaaatataatgaccttgcaacggtataaatccaatacttgtctcctaattctttgtgcaaatgctatcgtagcttttatttctatatacatataaatttctgcttctaatattatttttgctttaaacataaattacattttaagtactttttgaaaagaaaataaacctagtcttttgtatttactcatttatttactatttctggtgtatttcattccttcctgccgatccaaattttcttggggcataacttccctttggcctcatggttttccctttagaatttctggtcatggcaattgctggtggaaaatgtactcgggttttattctgaaaatgtctttattttacccttatttctgaagaaaattctcgctggatattgaattctctattgccagtattttctttcaagctttcatatcttacatcattgttttttggcctgcattttttaaaaatgtgtaataaatttatctttttttccctacaggtaatgtggggttttttttttcctctgtctgctttcaagattttttttttcatttttgttttttagaagtttgactattatgggcataactatagatctctttacatttattcttaagtaagttgtaatttcatcaaatttggaatattttcagccactatttcttcaaatatatatttttctgtctcattcacactctccttttctcagggactcaaataaatgtattttacaccattgatattgttcaacagacccctgaaatactgttcatttttctttaatctttttaacctcattacttacattgaataaattctattgattgattttcaatgttcctgactcttttttttttttttgctgccatcttcaatcttctggccccatctaataaaatttatttgtatttcaattactagattttttatttatagagtctccatatgatttttttatagtttccatttttctgtggaaactccctatgtgttcactcattaagatcagatttttctttaatttttgaccatatttataaaagcagcattaaagtctttttctattaagtccatttttttggccatcttgggtttgttatctatttttttcttttttttttttcttgactgtagagcactgcttctttgtatgactaaggagttatgtactgaacactgaatattggcaatcatatatcttaaagattctggattttgttagttttctccaaagaatgtggattcttattttaacaaggaattcatttgtttttaactcatgtagggtttggtataattgtaagcctcggatggtcctgcctggttgcaggtataagtccagcccttattcataaaccagcagaggacctccacatacaccttgaggaccactctctgcaatctccttatttttccgatgccatatttcacagactctagctatttcagcagccctaccctctgaattctgcctccttagttcagttagactgttaagctatgctgggacccctgttctctgtgcagcaattgggaaattgtttataacagagattcagggaagtgatggaactaatcttgtgagttgtctttctctaggggtcacagtcctctcttgcccgagttccattgcccaaaaacagttgactcacatatcttgtctaattttataggtgtttattgtggtagggctaatttggtgccagttttttcattcatgtctagaagtgaagttccactacttctgtctttttttccccctcatggcacttattaccctctcacatattagaaaatttacttatatgtcagacattaatagattattatctgcctcttctcaccaccttaccagaatataagcttcatatgaataaaggtatttgtctgttttgttcactaatgtatctcaggcacctagaacagtgcctggcacgtagttggtgcttaatcagtatattatctcagtcattttacaaataggagatggctcaaagggtgcatctatatgtattttttaactttcacattaataagtggtaaaacttgcttttgcatttgttctcaaacttctgactcaaaaacctatgttcttctcacagtagccttcttctttttctagtttctaaagtaagacagagaagaggaaatattaaggaataaaaaaactcggaggcaaaatgcacaactatgtctccatgaacttcctaagaagaggctaattataggtttatttactaactaaatacaatttattctacattctaggtggaaagctctgtacacaatgattaagacttattcctgggtaaggatattagtgaatctgattttggaattgtagttttataatcttatttatttgtgttttactttttaaaaactaaatatgatttttgaatgagaaattggagaaattgaagtctagtcatggcctagtctagtcatctatctattagctgtgaaactttgggtaaatagtaacctttatagacctgttattttcccccaaaattgttctagtaatacatgtttattccactacttctttttaatgtagatgaaacaagaaaaggaattccaaatgctttgaaaattataaactgcaatgtattaaatattatctgagctgtttaaaatttaaagttggtaagcctttataagtagtatgttaaagattacaagtaaaatgatatgtaaagagcagcagcagtattgaaggacatgtgtttattttgtgctaaattgaactttgcagcaggccttaataaacctaaaccagaaaagaaaaatttcttttacttatttgcttgaaaagaatgttataagacaaatttacttcagatttcttcaaaactttccattaaacttgttgtgggtataatgagggaaacttttactaatataaaaatataagacatagagtaaaaatgaaaagctatttcagggtacaatttcagaaaaggatttaagagtttggatcatgtttccacttcagagctccttcaagggattgaggggaaatggtgtagttttgttttcagttacaaatcggcatgatatacattatgtaaaaattatgcgagattaaacaccttttagttgcccaaggagaaatgcttctttctttcacatataaattcaaccttggccaggcgtggtggctcaagcctgtagtcccagcactttgggaagtcgaggcaggtggatcacttgaggtcaggagttcgagaccagcctggccaacatagcgaaaccccgtctctagtaaaaattcaaaaaattacccgggggtggtggcatgtgcctgtagttccagctacttgggaggctgaagcaggataatcacttgaaccaggaggcagaggttacagtgagccaagattgtaccactacactccagcccgggcaacagagcaaaacttcatctcaataaaaataaaaatgaaaataaaaataaattcatccttaataattttctttgttgatatgaatacttgttctgtttgatttagaaagtcttgcataattcagttgtatttctcttctcttcccttgggaatgcaatgaggaactggttatatatatactttgtaaagaaaatgtggtatcttagactaaaactactttagcaaatagtagttggtaagttaacaccaactactcccatccagaaagaaccaaccacataattctgggtttagtatagcatttatctcggcctctgagatcacattttaaagtgttaaaattgaatcttctctttgggatgttgcggtgagaattgttttttaagggaaaaaaatggagaaaaaatgggcaaaggaaattaacaagtaaaatctaaatagcttgaccaaaataaaattcgtttgaaaagaataaaaattaatgctttcaacctagtacaataactgagaactagataaatctatggactaagaggtccttgtagatactgcatgtgctaggatgaataaaagagattggaattagcaaatagattatgtgtcagtaaatatatgcttttaaattacttgaaggcacacaaaacagtttgtttaaaataacttgaagatcttagacattccctctcaaatgttatttacccactgcctcgctttgtttcagaaagctgtattccattcttttgctagaatgtaaaagtacacccatcatctttgtccctggtcctttaaggttaagtagaacactgacaaataatattcctctaatggagtctaaattaggagtaacaccttctcttataatgataaaatgagcactgagacctcaagattttaaaaagccatcataaggggtagtaaaaacggttacaatcactatactgcattgcaaattgtggtgactttggtttggaatatagtagtatgtcagcaacagatactgcttactctaaatcaacattcctttttctaacttactaaagaatctcaattttctacaggtatccacctatgcctcatgttacttggggagaggtgaccctatccttgcctcaggggcaaatattagttgggacaaaccagttatgataggtaatctcatcctcatctgccaaccctgccccactgacccagagttgggtcccatgcccagcatgggaatatgagagcaggttttttttgctttttggaaaggtttccttctttttaagacaaaggtgctagaagtaacggcatctttgtgcttccatgtggatgtaacgtgagctgcgatagctgtcttgcaaccctggggagagctatctgtatcagtttattagggctgccataacaacgtaccatggactgtgtggcttaaataacagaaatttatttgctcacagttctgaaggctggaagtctaagatcaaagtgttggcagggttgctttctcctgagggctcttgccttgactcttctcattgtgttctcacatggtcttttcctggtgcacgtgtgcacctgttgtctcttcttgggtgtccaaatttcctctttttataaggataccagtaagattgaagtaaaacccattctaatgacctcctttcaacttcatcatctctttaaaggctctatctctgaatagttatagtctgaggtactggaggatagggcttcaacatatgaattttggggagaggcaattcagcttataacaccacccatgggacaaatgagctcgctgacaatggtagaaaatatcaatggaaaaaatctgggtcctggatatgagataatatatatccttatgctgtgtaagcaagttgaatatgcattttctcttacttgaaattgaagacacataccttatatctaagaaccatggaacaaacaaaaaaccatcaatgtcactcctcttcctagactgcagagtttcaccagttagtctgtaatattgaaagagcatctggaagttcttccagttggagaaatagctgcatgtgttgaagaaccttctcaagtggcaagaaatcttcctcttgtagcactccccaggaaagatttggtattctttggacccagagaaaatgcttcaagtttttgaagctgcaaaaagactcaagatagttacatacagatttaaagtgtgccaatggaaagaatgttgtattcgggaaatacttagtttcttttatgtgcattttccccatgacaatgcatgaaatgtgaatattaatatttagacagccccttaatggttagatagctagcaaccaggctctgaatactacaagtaaaaaaagttctacagaaagctatttcttataaatattttattaaatggctaatgaaaaataaatagtctgcatttatctagttattgcacaaaacattttcatgcgcattattttagtgaatcagtacaccagggtgggatttttgtggacttattttgcataccaagaacttacattaaattgtccattcaaatgaataataagagtaggagccaggaaccacaggcagattttctgtctctaataggtagaaatcccaatttgcaaaacaaatacataaacaacaaaacaaaatataaagcaaccataagcatatttttaaagattcttttatcaaatgacaggcatttttgccaactgggaaaaaataatatggaaaaatgttatttggctttaaaagaaatgaaaggtataaaagtagaatcatgaaatttctaaagtaaaaaatgtctggattcgggcaagatggcccactagatgcagccaggtagaactgctgccactgagggactgggatgactggcacactcctaaaagatcttcagagggaaggcactgacagtgaatgcagaaaaaaacacagaaactgggctgaaggggaagaagctgggaaccatgtgtggggcttctgcacaccaggactcattcttggcccccaattactccaggggaatgggcgagttgaactggcagcaaacaactcgctctagccatgagcctctggaatcccagcaagaggaaacccctcaaccactagggacacttgagttggcagggagagctgcttagagaagtggtaggggcagcaggccagctgatgcagagcctacagggcttgctgtaggagcatttgtagtagagtagggccaggggtgcccatccctccaggatcaacttgctcccataggagactttagccctaggggaactgttggaacaaaattctgcagtgttgtcttgcccttcagatggggtggtgtgacctgagcaccccttgttccactggtttcttctgggttcccagcctggctgcacctgtttgcattgcagcctctggtgccctgggggcctgcatcatagcttctgcactggtagatcattcctgaacagtggacagcttcagtagggcagtcctcactgccatacaccagtctgcccactcccccttcccactgcagcttccccagggtccatggccacccccatattgctttgtcaccatgtgtggtggggggacactttgccttccctgccctaccagggcacatggatgtgtggaccctgccagcaggagtgcactctgccttccctcacccaccatactgccattgaagttggagccttggcaagcacagagcccactagccccacccctgcaccaacactgggagtgaaactaggcacacagaacaatagaccctcccctgccctgagcggccacagagggtacacaaagacctgtgcccgccagtgcccctcctctgtgctaacaccaccaacaatgcaaccatgcatacagtcaccaacaggatgccccctgcccacaccaatcataccacctttgccactgctgtgaacacctgcatgaaggcaggcaccccaacatccactagcatcctgcgacagccgacgggtgtgcaccccaccacactgccactgctgctggcacatatgaatgagaatggatcgcactgccatcaccctatgaaatgctttgtctggcagcatgtatcagaatgcaatcaacagtggccaacaagcacttaggcacccctgccccatgcagtggattcctaacctcaaggaaccagagaacaaagttagggcctgttataaatcctccagaggtagagcacacagtctaggagttgggagatgactgttggtcccctaaaatcttccaaaaatgaatccagtagactggacccaccttataccacaagcaaaccctcaatgccatcaaataggataaaagaaaaaaatctaaaggacagcaacttcaaagattgaaggaacaccagtccagaaacatgagaaagaacccgcacaagaagcctaataacaaagagccagagtgccttctttcctccaaacaaccacactacctctccagcaagggttctgaactgtgctgagatggccaagatgacagaaatagaattaagaatatggataggaacaaagatcattaagatgcaggagtacattgaaaccaaatccaaggaagctaaaatcacaatgaaacaatacagaagctgacaaacaaaatagccaatattaaaaagaacttaaacaacctgatagagtggaaaaatgcactgcaagaatttcataatgcaatcacaagtattaatagcagaatagaccaagctgacgaagaatctcagagcttgaagactggctttctaaaaataagacaatcaggcaagaatacagaaaaaagaataaagacacataaacaaaacctccaagaaatatggcattatgtagaggccaaatctatgactcactggtgtccctgaaagagatggggagaagagaatcaaattggaaaacacatttcaagatttcagtcatgagaacttccccaatctagctaaagaggccaacattcaaattcaggaaatgcggagaaccccagtaagttacttcacaagaaaatcttcataattatcagattctccaaggtcaaaatgaaagaaaaaatgttaaaggcagggtgagagaaaggtcaggtcaggtcacctacaaagggaagtccatcagaccaatagtggattttttagcagagacccaacaagacagaagagattggaggccaatattcaacattaaaaaaaaaaaagaaattccaaccaagaatttcctatccagccaaactaagcttcataagcaaaggagaaataagatcccttttcagacaagcaaatactgagggaattcgttaataccagacttgccttacaagagcttccaaaggaagcattaaatttgaaagactaatcagccactacaaaaacacacttaagtacacagaccaatgacactgtaaagcaaccatacaaacaagtctgcataataaccagcaaatatcacgatgacaggatcaaatccacacatatccataccaactgtgaatgtaaataggctaaatgccccaattaaaaggcacagagtggcaagctggataaaaacgcaagactcaatggtatgctgtctttaagagacccatctcacatgcagtgacacccatagactcaaaataaagggatggaaaaagtctaccaagtaaatgataaacagtaaaaagcagaggttggaattctaatttcggacaaaacagactttaaacaaagattaaaaaaaagacaaagacattacataatggtaaagggttcaattaaacaagaagacctaactatcctaaatatatattcccctaaccgaggagcacccagattcataaagcaagttcttagatacctacaaagagacttagataaccacacaatattagtggaaggcatcaacaccacattgacagtattcaacagatacatcgagacagaaaattaacaactcagcactggatcaaatgggcctgagagacatccacaaaactctccactcaaaaacaaaagaatatgcattcttcttatcaccacatggcacatactccaaaattaaccacataatgagacataaatcactcctcagcaaatgcaaaagaactgaaatcataacaactactctcttggaccacagtgcaatcaaattagaaatcatgactaagaaatttactcaaaagcatataattacattgaaattgaataacctgctcctgaatgacttctgggtaaataattcaattaaggcagaaatcaaaaagttccttggaactaatgagaacaaatatacaacacatcaaaatctctggacacagttaaggaagtgttaagagggaaatttatagcactaaaagcttacatcaaaaagttagaaagatctcaacttaacaacctaatatcacaatgaaaaaaactagaaaaccaagagcaagccaatcccaaatatagcagaagacaagaaataaccaaaatcagagatggagacatgaaaaaccattcaaaagatcaacaaatccagtaggtggtttttaaaaaatattaataaaatagatcactagctagactaataaaaaagaaacaagagaagatccaaacaaatacaatcagaaacaacaaagggaatattaccactgacccgacagaaatacaaataaccatcagagaatattatgaacacctctatgcacacaaactagaaaatccagaagaaattaataaattcctggatatatatacccttccaagtgtgaaccaagaagaaactgaatccctgaacagacaaataatgagctttgaaatttaatcagtagtaagtagcatatcaatccaaaaatctcaggaccagacagattcacagctgaattctagcagatgtacaaagaaaagctggcaccattcctgctgaaactattccaaaaattgaggaggggggactcctccgtaactcattctatgaggctacgatcatcctgataccaaaaccttgcagagacacaacaaaaagagaaaacttcaggccaatatccctgatgaatattaatgcaaaaatcttcaagaaaatacttacaaactaaatctggctgcgcatcaaaaacaatatcaactaaaatcaagtaggctttatctctgggataaggtttagtcaacttatgtgaatcaataagtgtgattcatcacataaacagaactaaagacaaaaaccatgtgatcatctcaatagatgcagaaaaggcttttgataaaattcaacactccttcatgtttaaagctcttaataataagagccatctatgacaaacccacagccaacatcatactgaatggccaatagctgggagcattccccttgaaaaccagcactagagaaggatgctttctgtcactattcctattcaacatagtattggaagtcctggccagagcaatcaggcaagagaaagaaacaaagggcatccaaataggaagacaagaagtcaaaatattcctgttcacagatgacataattctatatctagaaaaccccatagccttggcccaaaagctccttaagatcataaacaatttcagcgaagtctcacgatacaaaattaacatgtaaaaatcactagtatgcctatacaccaaccaccattatgcagagggccaaatctggaatgcaatcccattcacagttgccatgaaaataaaaaaatacctatgactacagctaaccagggaggtgaaagagctctacaatgagaactagaaaacactgctcaaagaaatcagagatgacacaaacaaatggaaaaacattccatgcttatgtatagaaagaatcaatatcattaaaatggtcatgctacccaaagcaatttatagattcaatgctattcccatcaaactaccaaggacattcttcacagaactaatgaaaactattttaaaagtcatatggaactgaaaaaaagcccaaatagctaaggcaataaaaaaaaaaaaaagctgggggcttcacgttaccagacttcaaactatgctacagggctacagtaaccaaaacagcatagtactggtacaaaaacaggtaaagcaatggaactgaatagagggcccagaaataatgccatatgcctaaaaccatctgacctttgacaaagctgacaaaaacaaacaatggggaaaggactctctattacaatagcaaatcctgtttaaatgcccattaatggtagattggatagagaaaatatggtacatatataccatagaatactatgtggccataaaaaagaatgagatcatgtcctttgcagaaacatggagaaagctggaggccactatccatagcaagctaactcaggagtagaaaaccaacaatgcatattctcacttacaagtaggagctgaataatgaaaacagatggacacatagtggggaacaacaaacacggggcctacaggagggtagagggtagaaggaaggagacgataaggaaaaataactaataagtactaggcttaatacctggattactaaataatctgtatgacaaacccccatgacacaagtttacctttataacaaatctacacatgtactcctgaacttaaaataatttaagtaaaaaaaaataaaaaatttgaactgaaaaattctctggatgtaatacatcagggaatattttaatattttttttgaaaactaataatataagatatcttaataacataaagagaaaaaagacattatagacaggggagctaaaataagaatgattactgaactgaatacaagctagaaggctataaaacgacttatttcatgtaacagaagaaaaatgggccaggtgcagtggctcatgcctgtaatctcagcactttggaagggaggctgaggtgggtggatcacttgaggtcaggatttcaagaccagcctggccaatatggtgaaaccctgtctctactaaaaatacaaaaattagccaggcttgatggtgcatgcctgtagtcctagttacttgagagactgaggcacaagaatcacctgaacttgggaggtggaagttgcaacgagccaagattaagccactgcactccagcctgggagacaaagtgagactccgtcttaaaaaaaaaagaaaagaaaaaaaattggaaaactcacaactgtcaaacaataatcaataagaagcgattagatctgggaccgaagatcttattagaattgtgatcaaagagtaaaactcaatcattagaattttatttggttccccttcacaggtaccatgtaggaggtaccaaagaaccagacatctgtaaactaaaattttatttttctgttctcaactaattgtgcaactgtcttactgtcaaatctctaaaataggtggtcaaactaaatcttagactcttctaagattctttgaaattgtgatgtggagtagaagcaaaaaatatcaaaattaatgcctccttatagagcatccaaaaatgttttctaactgcatatttgatgcaaatgtacccaaagaatttatcgtattatccagacaaattatattcaggcatatatatgtatgtgtgtatatatgtgtgtgtatatatacatatagatatatatgttttaacatttgaaatgtaattcatgacattggaaccatttttgtattgaattagatgtaaaataaattgatactgattccattttacaaaaaagttaccatatagttaaactataataatttccattgatggaaattaatgccactgaattatgtaaaactgtaaaaaatataggcatgttccttttgttttatttcagaacatatttctataccaatgagtaaataataattttatgtttctttgtggtaatcagaaaaaaatacacactactcttttatttatgcggatttaattaccatatttacatattttctgccttttgattggttcatacatctgttcttaatggttctatgaaaattatattaaaaccacaacgtcaaggttttgatgagtagctcagaagcaacccaagtacaagacaaacattagaatataatgcttttcatggctagtgatggagtggggccatttatcatagagccaaaaaagcaaaaaattagagatacatcagcttccatgtttgagatttttaaaaatagctaaatgcttccaaatgtgcaagtttacccaaagctactttaattttactctgtttctatactaggaataaaagtttccaaggatagagtaatactttcttatgaaaattccaactgatcatactaaatatcaggtcaaaaatcctgtttaaaagatatgagatggtagtgattttcttgcatgtgagcaacatgaaaatataaagacagatcttaagaactattcaatcaacacgtcataaacagtgtgttcaaaatttagaaaatatatttgactatcttttgaatttaggctggttcagatagtaacctatcaagaaagaatgaaccagtttaaggaccatggaataagggaattaggtaagatgtaaattggaaattatagatagcactgattgcttaatgctgaaataatcaggaatacaaatttatcctgtgtcttcttgagtggttcaagtgcttctcccagatggaacactgaagtgccatccttcagcttcacatcgctaatatgtggagattcaagtagccaggtacaatagactcaaataccattattctgttattctaagatacataatctaaatacagaataataaagcaaatgaaatctcattataactttcaattataagattcttggtcattgtttgattttgttttgttttattttgatactgagacaaaattataactaatataagcaccaagtcaacaggaaactgagtattcactaagaatggctaccattccctagtcacctttctaccatcaccattccaaaattagttaaatcaagaaagaaaagataaaagggaaaaaggatttattgtttatcagttcttattccctatcctttcctgtttaatacaaatggtattagacacatggaaatttttttaaaaaatacgtaaagaaggatatgattgtatgaattggttctaccactttggagagcaatttggctcaatgacaaatatctccaaaacattatattgagagaaaaaaattgacagcatattaaatcttattattgggtacataccaatataagaataaaacatgcatgtaaacaataaacatgaaatcagaatggtgtttatgttggggaggaaaagaggagtagaatatccagagagagaaaaacacagaaatattttattatgtttataatgattaatatttttataccaagtgttaggggtgtttattacagtactattttacattttggcatttctaaaatattccataataaagtttgaagaaagcaagactatttagctagaagctagaagagtgatttagtttttatgtgaagcatgagaactagctgttttctgcctccataaatagaattggaaatttaggctaactacaaagtttactttcccactttagtgagttcttataggttgcaaagaaaatttatgtggctttctgtgaacatcgtgatgatgaggctggattcttatctttcttaaggagcttgggtggtcctggtttaaagtgggcgacatcgcccctctgctcctctctgactttttagttcttattgagagattacaatcgtttaagatgagtaagcagaaaagggaggaaagaagatgtatgagtataaatatcagagattaaagcccccaaatgaggccagataataaacatcagagaaatggtctctttcatttttgtcctttattgtagcacatttctaagccgactagatttatcttcaattttcatttcattcaatgttttgaatctttttttttattgtagaggcagtctcctggaaaaagaccttaaaaatatccccaaatattcagccaaatgacagagtcagttggaaagagtgcagtcattcacttttccatttctgtgtccagttgagattgttgcaggcaatgcccgtgttcattatctcttttactgagacaagatttaacctcacacaacatctggaaatatcagaccttttactttctggtatttctggatgagggaccacatgcacagactctattttgtaagtactgtataggaagagcaagcattttttcaataccatttatcaattgttaatgcttaaatttctgttttggtgtgacatttctgaaattcagcctcttctgttacatgtttagaaatcaatgtgcatgtttatatggacaggatggagtttgttttatttcttaccccctgaatatttgctcactaggtctgctaggggacctgccagttagagaaaatgaccattatgaaactaaggttttttgcattaattcgttatgcagtatagacatatttcccagaaaatcaattttgccaacccggaaataatgcaagcaccatgactgccaggatttttgtctgttgtgtgtgtggcttttttattcccactagaaataaacaaaaatcgttttgacttctcagtaatgaatgtttaacctaaatggtaagggatgaagtcatttttttaatgttagtggaagttggaaaatccagaagtgcctatcatataatctcagttatttctacaatagtacgaagtttgccgttttcttgcatcttgtacacacacacacccccacacacatatctgctaaggaggaaaataacatatagcatgaaccaggttattcaataacaatctggaaaatttctaacttctttatgctaggtcttccaaaatattagctatgtatttattcctgatactattctgtttcaatatgcttctccatgggtttggcttaatccacgtgtatatgcagtgcagttaaatggtagagatattttaaggctttttctaaatttctttcccaaacaataagacttcgggttcataagtgagcttcattcctctctgtctccagcatgataacagtaggatgatactcaagaccacacaaagaagaatccaagagaagaactagagagaaacaacacaagcatgagatcccagttgactggggaggtgacagtaatgtggattggactctggaaggtctgagtcttaattctgcatttgtcagaagtcagttgatgaactgggaagttacttagctcaaggagtttactcttcatctgtataaagtttgggaataaatagtctgaggttcttataagttctcaaattctgtgagcctatttctactccacttttataaaaaaaatagaaattatccaaagcaaaatgttgcccttttttaagacactttttcttacttttttttttaaatcagctgtccttcaggtttttaaaaaatctgtcaaaattatttttagttttagtaaaaaataaaactttaacttctaaattttaagaaattcttatttgtagaatcacaaatcaaaatttcctgagattctttagtttatttcttttcttatttattattaaatcattttttacaagatgcaaatattctacagcctgttcttttaaattggtatgtgtaattgttcagcatgttcagcttattaactgctaggaataaggctgtcattcattttgatcaataaaacaagtatctttactttggaggaataatgtatccaaaacaatcaacaaaggggcacttgtcaaccttttagctttggttaaaagaaaaaaagtagactcataacacaccactctcgaccacagtgatctttcccctgagctgcaacgattgtgaggcatattttgtgaaagcaactcgtatgctctcctccagtggttgccatctacacttcaatgtcctagtcctccagcacactgagatgcacccctactctcgtgttcctctagaaaaattattattataaaaacaaaatggactatgaaaaatagcctctttgaacacaaattaatttggagtagactttatatagttatgagtcaatttttcttccacagcaaaacacaattccctttaaaatataaacaattggtggattttataataattttaaatccaaaaccaagtaatacctttgtacatgtatatgtgttatttacacatgtatatagtatgtatatgttatttacatgctatttacacagaaacagagagagagattttaagaaatgaaggaatggttcataaaattgccggggctggcgagaccaaaatctgcaggacaggctgcaggctggcaagacctagggaagtgttaatgctgcagctccattctgaatgcagtctgaaggcagaatccccatttcattaggggactccagtatttttctttttcttttttttctttatacgttaagttttagggtacatgtgcacaatgtgcaggtttgttacgtatgtatacatgtgccatgttggtgtgctgcacccattaactcgtcgtttacattaggtatatctcctaatgctatccctccccgctccccctaccccacaacagaccccagtgtgtgatgttccccttcctgtatccatgtgttctcattgttcaattcccacctatgagtgagaacatgcggtgtttggttttttgtccttgcaatagtttgctgagaatgatggtagccataaaaaatgatgagttcatgtcctttgtagggacatggatgaagctggaaaccatcattctcagcaaaccatcattctcagtatttttcttttaaggccttcaagtgattagatgaggcccacgtacattagggggggtaatctgctttactgtgctctattgatgtaaatggtaacttgagctaagaaataccttcacagaaacatttaaactctgtttgaccaaatatctgaggactgtgagttgacacataaaattaaccatcacagtgctcaagctaaataacattattctttgctaatttaagaaataaactggccagtcacagtggctcatgcctgtaatcccagcactttgggaggctgaggtgggtggatcacaaggtcaggagttcaagaccagcctggccaacgtggtgaaacttcatctctactaaaaatacaaaaattagccgggcatggtggtgcctgtaatcccaggtacttgggaggctgaggcaggactccagcctagtcaacagattgagactctgtctcaaattaaaaaaaaaaaaaagaaagaaaagaaagaaactaacacatccagcaaatgtcagtgtggtacagaatctatgggtggtttaggaaatagttaccagaatgaaacttttctcctccacacattaagctttttgctctagcacactctataaatatttgtaattctgaaatgtttttcatgaattctgaaacaagaattttgaaggagcatatgtcttctggaataatttttcaacactggaaatactgatttacttatgctgtacatgaggaagttcctagaaatgcacttttaactgaaagtgttcaagggctgagggagagatgggctttttacattgtatattccttgattctaactcaattaatttaaaatgcagggagtttagtgtgttaataaaagggatttcaggtgttatgggaatagagtaaaatgatagccagcctgtgagggagggaacaggggaaggaggctgtccagggacctgcacatctgagctgagaaactgtaaataacatggtggttattaaagtggctcacgagttaggtcagctaggctcagatccatgctctggtactaaataattgtgtcttcagaaatttatttaatttttctagtactctgtcttctcacctataaacatacagtttccaaagtgtagaaggattaaatatgaaaagtacacctaacgtacctcacgccttgtagtcagtggcacatagtgattaatattattaattattattattattgtcactaggtagaagatgagggactaaaatgagcatgtgctagttacattgatttgttttcagtgtctacatgggattggatataggtgtcagaagacacaatcgaatcgtaaaagaagaagaaaaaaaggaaatgattttctgaaatcattgtacattttaatgtgtttaaaatgttaagtaggaaggatgtttttgtaagagactattctgtaagatgtaactttaggcaaagtacaattgcttttaataatttatgataggagatttaaatgttccagttaatatatctcttttagatagtcacctggaaagtagcatttttattctagagatgcctccattgaccacaatgtttttatgtcatcaatttttctgtttgtattgtttcgttagattatgtcttttatgtttcttcggtgtcaggaaattgtttacttttaaatgcaattctgaattttgcgagctaaaaaaccagctggaaacaaatagagtgaacaatatggattatgtatttttttagtttttagtttttggtcatgtggcttggttctgatttcaaggagtggctgaaaaattaagcaggaaagcaattttcaaggaagtttaaaaaaacattttgtggtagaatagttggaatatgtctttaatatcaaaatgtaacaaactggaagatacataataaataccccttgttttgtttttaaaataataatttcattaatttatatagaaacaaacatccttttattcctttttattgaatatatacaatttaagtaacattactcatggcaaaacgctaatggccaaaccagaaccctaaatccagcagcaaaaaaaattccacctatgcacgtgctttttcctttctcacacaaacttatactttattgacatcgaaaagatataatcttaaattaggatggacttattatttttatatgcacaaagtgtggcagcctttgcctatgtctaacatattggaaacatagttaataggagaatgagccctggaccagaagccagaacacccaattccggcccttgctctacacgtctcagagttatcaggagcaagatgcttaacctcttgatgcctcagtttactcatctataaaacctggctaacaatatatatcatcattccctccaaaagttgtcataaaaattaaatgtagttgtacattttgaaagtctgaaaaatgtaaaataccaaccaaatgctaggtactgcaatatatgttcttcatacctgggaaaaaagagtcccaactaacaaatgcattttataagcccctttatttctaaaattaagtagatgaattatatcccagttattttagtttgttttctctttgtcatcacatgtgtaaaaagttgacctgttttaactgtagttaaagatacaaaaagctcaggttttttgacacagcctttttgaatgtagtaaaatgcagaggccactcacactatcaaaccaattctgtaggttgaaatagtggtctacactaattaggtgtgtcaatgtagagagaaagtctgtatgctctgaagcctatctattcatggagtattatctattttacccacaaacaggaatttccccacaatgtactgtcatcacagagcaattaaatatatggtttgcatacttctcaatggtaaatattttgcctggttcataaggtcgtatatcatgcatttgtttctatttctggctagaagagatggatataataattatattcaataaaactggaatgtaatcccacctatggtaattttttttcaaaacacatacatatatatatattttcaggagagttattttattaaaataacaaaatttagaaatcagtaatttttttttttttttttttgagacagagtctcgctctgtcgcccaggctggagtgcagtggcgtaatctcagctcactgcaaccttcacctcccggttcaagcaattctcctgcctcagcctcctgagtagctgggattacaggtgcacaccaccaagcccagctaatttttttgtatttttggtagagatggggtttcaccatgctggtcaggctggtctcgaattcctgacctcgtgatccgcccaccttgacttcccaaagtgctgggattacaagcatgagccagataatttatttttaaatatcaaatttatagccagaaatttgggttttggtttgctgtgcttacctgtcctgaattatagtagaagcaaaataaaatattagcatgttttaacctatttatttgttctctcaaaataacatattttgaagaacatctatcaccctgctaactaatgcttaattattcattaataaaaattctttataacttgaactttgttgactaattattcggactacgaaactccaccaaatattctcattaatgtaactcatgttttggatgtaataaaaatagtgaattctgtaattatcccaggtgctattaacatttgttgaacatgcagagcaaggggactacagacttctgccaacacaaagacaagagaaatttgctttagcaaatttgccttctatttctttattcaatctgattgagtatggtagcaagacaaagactttttttctgtttctggtgaattaattgcattgttagtgtttcagaaccatatgaaacaatttccctttaaattaatataaacgagaaaatgtaccacagtctctttgtatcttttgttgtttctcctttagagcccaatgtttcatggcagtcgagtttctggaattataaaaagtataaaattattttaaaaacagtaaaaaagattgtgtatacaaaaataattcttctaaacccattaaaaatagaattacctttctctcagaactaataagcaaataaaactagctgagattacaatcactcgatgtaaaaattctaatcttacatgattcgaagacaaatatttttcccaaaggcataacaataagcatatccaaatgttctttccagcagagaagaatgaaataaagctacactctataaacttcagtgcacgatgtgtcaactcaaggattagtgtgtatttcagaaaataatattgaaattcgtgtttttattacttagaaaaattcacttctgtaagtcaaatttattcatatctttttatttgtttactaaacgctaaaagacttcacattaacatcatcacaaatatttagccaagaatgccagctgttgattatgggcctatgacagaggacttggcatatttccaatcagatgcttctactgtatcccaaacagagcattttaaaatacagtgcttctctgctaacggatgttaaattttcaaatgagcatatttgggagaatgcatctacgtattgacacaaaaccaccagacatgggcattgacatacagctgagaggcaaggacatctcctaatgatatggcactgccaaaagccagagaagatgggagtctcacacatacaaactctcatatattcatgtccagaacagtgatagctcgtatttctcagtatttgccctgtctagctaagtgatttatattgactagctcatttaatcctttgaggcaggaactattcttctcaccattttagagatgaaaaaactgatggcacagagatgtcacattatttgtccaagttcccaaagccattttaacttctaagcccacactttaaatcactatgctatgaagtgctatctcacacacactggaattcagacacagggaaaaaagatcccagtgagacaattgcagcatcagattaggcatatggtacttcgagagtgccttgtctagcatgaagtcagaaaacaagttgagtggcctttatcgctctgagtcttccgtcttttgtttaagcatcactgtgcccagagttggcatttatcatatggctacatttaactaaataaaaatatcatcctttttcaacatatgaaaatccccaaacttcaaagttgactccaaaatgtgcttgtttttaaaaattggcactcaagtatttagggataaaggctctttatgtcggcaacttattctcaaacaagtcagaaaaatcactcatacacacacacacacacacacacacacacacacacacacaaagaaaatctgataaaatattaatttgggaatctaaatgaaagtataggataattctttgtgctgtatttgtactttttctgtaaagtctaaaattaaaaagctgcctggagattcgaatagtcaaaaaaaatttattgagaaacagcaataggaaaattaaggatacaaatatatccagattggcatgtccaaaataaaacattactcatttttttccggcacatgtagaagactgcttaacaccccctatcttttttgcaatatagactagaagagaaattaagacctagattatgttttcctttctacctaaggcctctatttcggttctagctttctatttgtggggttttttccccttctaggtcacacaatctcctttctacaagactgagttgcatttgaaagttttaacagataaacaaattagaatgcaataaaatagccctaatatccacaaaagaaatataatagattcacctttctacattgaggctaaaattgaatttcaaggcattaggtgaattagtgtatagccaaaactatcctagaataacctttacatagcccatcaagtaggggatcattgttttgtatagtaatgattatgcacagtaaattttgacaaccgctaacctgaacaaaaggaacaaaataaaaacttacatgcaaatgtctaagcattcaaatgattttgcttttaagataattatcaaatcctcagcagtataaggtgaggaataggggggcagtgagaagaaaattttaagtgattttgcttgatgtaaactttattccatttggtttcatgttaacataatatatgtaagtagatttgtttgtcagggttaaataagagtacagagataaattttgcttccagccatgaggaaggaactcacatcatggtaggccttctgtcacaagccattgtaaaagaggacaaaatgtgtgaaatcactgcttttagacattcagcaaaagacaccacgtgactatgatccctgaaagaagggcaaaaacatgagatgagtcctgtaattgtaccagctttctgcctggtgtcacttcctaggctgtggttcagagatggtgcccaaaccaacacagcggtgccacatagcagaggagacagagattagaattcagggccagtgaggtgactggaatttgtattgcaggatcaagagagaagcgagctgagcagaggaggagttccaaaaatctgcatagaggtccctttgagtctttgaatagcaagctgtttatattcagattgaaactctctgaggcaggacaaagtataactattaggaagagaacaaacacaggagaactgtgagttgagctctcagagctagacagagtgtggagatatttgcattctgacttgccaaagtgaaagcaccttactaaacactgtaggtacaatattgctatagtttggagctttgtcccctccaaacctcatgttaaaatttgatcctcaatgttggaggtggggcctaatgggaagtgtttggatcgtgggggctgatctccactaaatagattaatgccttccctgggggcaaggtgagtgagttctaattctattagttccctgtgagagctgcttattaaaaagagcctggcacctccctcctctctctctctctcttgcttcctctctcaccgtgtgatatctgcacatgccagctccccttcaccttctgccattaatggaagcagcctgagactttcatcagatactaaatcttccagccagcagaattatgatccaaataaaccttttttctttacaaatacctagttcctagtattcatttataacaacacaaatgaactaagacaagcgacacaaatggactaagacaagtagaaactccacacaggccataccttagaagtagggctaatctagtcctacaagaaaggttattcttgacctaccttaacaacaagacttgaaagtatcaagctcatctacaggtaagttaactgcctatgggaaaaaaacttaacactcttattaaggaagatgatagaaatccagtcaacaatgaagtatccataatgtttaatgtataattttaaaatgaccagtcatgcaaagaagcaggaaaacatgatccattgccagaataatagtcagtcactcaacaagaacagacccagaaatgacacagataatgaaattaatagacttgtctttaaaataactactataaaaatattcaggaatttaaagagagaagacaacgaaaaatagaaaatctcaactgggaaacaaactataataagaaatactagagataaccagaaatttaaaattcaccaaataagcttatcagcagattaaatactgcagaaaaaactatcagtaaacttgaaaatagagcaatttggaaattacccaaactgaagcacagaaagaaaaaacagctgaaaaatagtaatggattatcagtaacttatggtagaattgcaagcagatttaagaagttaaacaatgcctaagcaggaataacacaaagaagaccataccagggcctattaattagggttccatcaggtaagtggaacgactataagtgatgtacagtcagggatttattttgaggattagaccttaggcaattgtagaagcttcttaagtggtctatataaggctatcaactctgtgctaacattaggcctgaagtcagcaaggaaatatagacattaattaagggggatccaagagtgaaccctgagggaacttgtgggggaaaagtgaaatctataaggcaaaactagaacccacgagaacaaataggaacatgtatttgtcccactccctccaatcttgataatgtaagtgaactgaaaacaaagctggcactcttccctgtgaaactatacatgacttggcctgggattcaaagatctaacaaagtatttctggttagaaaaactaagcccaggttttgctccccattaccagtgaggtaaaccagtagatcagtaacagtatgcatgagctacaatagtacctcaccccgtgccaaccttcacagtgttaaagaccagctgttacttcacttctaccttcccaatctcacacaagtttctgttgtgacccatcataaactggaatgatacagtgaaaggattcctgagaaacattccagtttagctatactgaactgttgccacagtccacccccttacaacttggcactcccatatacacctttcaacaatacttaacttctaaatgaagacaatagtaaaattatctttttacatagcacaatactgatatatactaaaatactgatatataactaaaaacatgctaaaactctctgaaaagatgatacaaaatccctttattcaattttggttaatgtttatttttcttctaatcgaatcacactccccctaagatatattataacttaaatactgaaatataagctcagttactattaatacttcctatgttatatgttagggagatggagggagggaaaagatagttggatggagaaaaaaatgtataaatatcttcatataaaaataagaaagaaattctcaaatattatggtgttcatttctgcagctggtgacatgatttcagttaatatttgttacttcagtcttctactacccactcctattccctttgtcttcagtaagcactttgcctggtcataattctttgcctaatggggtaaaacaagccttcatccctgaagtgagataaactgctaatggcccagccatttgcagttttgctgtagtttttctttgactcttatcacagagcatggaagtattaagatgtgtcccaagatattttgtgaattacaaacacattcctccttaccaccatagtgcagtcaaaacttaatttcctcttgatggtcaaaatcagtcattgcagtcagtataacctccccttctctgcccattgatttaccaccatgagaatccctaagtggtcatatgacagcgtcaaattttcatgtaatagaaccattgctatgtcccctggtggaagcattcctctcttgagaactaagacctctagacaagatgagccaaggttgcatagataagaagcaataattttgttagtaatggattaggggtaagcaaggagataagccattcactttcatttccacttcttgattcccagatctgtgtaatgagagaaaaacactacaaattggacacagattcagagcatatgctctattttggatgacattactcaagccctacaaagtgttgccatgcatctggcaccataatttagtcttcaaaaggccattctatcaggccagctgcttcagagtgatggagaacataataatacaagtgacgtccatgttcacaaggccattgctgcattttgttagctgtagaatgagtttcctggttagaagcaatgctgtgtggaatatcatgttggtgaatagggcattttataaatccacagagggtgattttggcagaagcattgtaggcagaaaaggcaaatgtatatctagaatgagtttccattgcaatgagaacaaagcattcccccttttatgttagaaataattaacctacttgctaccaagtcacaagctggtcctcctgggggctcagtatccatctcaggtagcaggttgggcactcagcagtggcagttgtcagatcagctttgatgagtggaagtgaacattgcttagcccatgcatagcttccttcgctgctgcccatgaccactttgtttatgagccaatcggacaaagatagatgtagctgcagaaacaagttcatttatatccatagaatggaccactatgcccacttattcatctgaagtggctctttggtgagccttgatatcggacacaaatatcttcatgatctatgcctgatgtgatctatgccaagattcacatacatctttccagacctcattatcaccaagtcaccagtcatgttccttttaattgagaatcattcagccaaactcttagccacaccgtttaaactagtggatatctgaccatatctcttcctccagataaaactttacccaaggattacaacaggcaaaaatatatttttttgtgttttaatcagtgctataaaaccaggaaataaaataaattaaaaacataaatgttggaaagaaaaaaagtatactgtctttattcaaacataacatggttgtgtatggtaaaaactataattatctaaaaaatatactactagagctcatacatgattttaacaatgccacagacataggttaacattaaaataaccattgaatttctatacactagcaaagaatgggaaaactaaataaaaaatccaatacaatttaaaatagtatcaatggacacaaaatacttggaaaacttaaataaaatatgtctaagatctgtatgctgagaataaaaaacattgctggaagaaattaaagaatatttaaataaatagaaatatataccattttcatggatttgaagactcaatatttttaagatgcattttttttttctaaattgatctgtagagtcaaagtattcccaaacaaaatcttaggtgtatttttattttggtagaaattgacaagatgtttttaacatgtatatgaaaagaccaaggctgggcacagtggctcatgccagtattcccagcactttgggaggctgaggcaggtggatcacctgaggtcaggagttcaagacaagcctggccaacatggcaaaaccccaactctactaaaagtacaaaaaaatattagccgggcatggtagcccgtgcctgtaatcccagctacttgggaggctgaggcaagagaatcgcttgaacctgggaggtggagattgcagtgagccaagatcatgccactgcgctccagcctgggtaacagagtgagactctatctcaaaaaaagaaagaaaagaaaagaccgactactcagaatagccaaaattatcttgaaatagaaaaatactttgtagtacttatatcacttgatttcaaaacttattaaaatcaagatggcatgatatgatgtaaagatagattaatagtttaacaaaaacgttagtgagtccagaaactgaaccacatttacccagtcacttgatcattttttaaatgagtcatcaacataagttaatagggggaagaaaagtctttttgacaaaaggttctgtaaaaaatgactacttataagaaaaaagttgcgcctcaaactctgcaccattcataaaaattaattcaagaaagatcatagtcctgaatgtaaaagataaaattctaaaacctcttgaagaaaacatagcagattatttttgcaaccctgtgagagacaatccgaggccctgaactgtgggtttccatgtctgtttttgcattgcccaattttagcaaaaattctgtcaaatttgtttaaccagaatctctcacccttcatatctgatcattgtcaatatttgaccaaattccttatctcccaccacctcccagatgatatctgattactctgccctgacttcagcaagaatcctgttaagctgatttaaccagaatcccttcttactcctcatgtttcctcttagtaattttccatccactgccccaacttgcttcttgtctataaatgctcacttgtctttgctggactttcagagtctggaagtccaagatcaagttgtgagcaggattggtttaggggctggacatggagaatgtgccagtacagtggtctctgatgtccctttttataaggacactaatcctgtttgatgagagcctgtcaccattatgacctcgcttaaccttaatttcttccttagaggtctcatctccaaacaaccacacaggggattagggcttcaacatatgaattttggggagatacaaacattttgtccatagcagtcataaaaatgtcagtttggattaactctaaaataaataatgcattgttttacttagtaagaaagaaccaatctctgattctcaaagcttgggttctcatcagcaaccgaggccattgagtcaaatagaaataattacacattcaagatgttatctaaatatgatacaaattgaatattagcgtaacctactgacagaagcttgccttgttaacagtacttacttacaaaaaaaaaatttgagtgtcttctatgcaatacccaatatattaggaactgttattaaatgaggtataatgatatgataacaacaagccatatggttacagacatacttcactagctgttctgcaggatgagcatgaacagtagcgttgtataaacaatttagcattgccaaaatgaagtagtgatttgaagtgattgtatggatatatcaaaataaaacttgctaaatggagtaagacaggttttagcatgaattaacgacataattatttcagcttatactttagctaccaagtcctggcataggtgtaataggatagagtgctaggaagcacaagcctctaaaagtgagaactcagatgttcaaacacagaaacccaacaagcctgaaaaatattgccctacgagaaattagaactccaaagagttgctttccaaagttaaaatttctgtggtacaacattttcattctcatgaaaatgataacttcttagaatggataccaaaaaatagcaactgggcacagctggatggctgcctggtctttagtgcaagagtcctgatgtttttcagacaagaggccagttgttattgagtttcagagagaaagaattatttagtgcaggtatactccttacccatttgtgtatatgcacgttttatgtatagctctgttctataactgagagcttatgacagagagtcataagtctcttgaagaagcaggaagaagaaatgataaaagggaagccaaggaaagccctgcctgacaaatagaacacctgtcaggtcaacgttccatgggatctaacagtacacactggtgcaggcccaattagctaggcaaatgatttaggtattaaagggacataagtcatgagaacagagtgttggtcaaagtcaagtttaaaaagtgagactttccttcactaatgaaatatttcctaataaatttcctaataaaatatttcctaatgaaaaaggtaaagggtattaagaatctttgtttttatttatttatgtattagagacagggtctcactctgtcacctaggctgcagtgtagtggtgcaatcacagctcactgcagcctcaaactcctgggctcaagcaatcttcctgcctcagtctcccaagtagctaggattacaggcacacattagcactcctggttaatttatttattaattttttttttttttttgcaagtacagggtctacttatgttgcccaggctggtcttaaactcctggcctcaagcaagcctcctgccttggccttcaaaagcactggaattacagccataagtcactacacccagtcaagaatcttttcaaactgatacccgttacaaggaattttaaccacttggactgccagtctgataaaacttctgtaacagcactagcatgtgaatttttgtttgttttttaaacagagctttagttacgtagatctgaaggaacgagatctgtagaaaagccatttgatccagcactcaaataacagttcttgacggaaagaatgaagttctaaactataattattagccaaaatgtcattatacattttaaaaatcccatctttccagacaaaatagttggaaaaaaagaaatgaatccaataaagcattgtctctaaaaaattcattggtactgctagcatgatttttaacataattcatttaagattttataataggtaaactggacataggaatgctgccatgtttataggccgctcaataggaaagatgaaactcatcaacaaaggcagacatattgcagccacctaaccttgtctgccacataatagtttccctataaagatttgttgatgcattgactgcttggtttaaaggccctaatagtacagcattaatttcttatgaagtactttctaatatcttgcatttaagttttaagtgtaacctttgctatattatgggactgactcttttattgcattaaaactaacggatgcatattgagtaattagctttgcctttctttctatactttctcttaaatctttataagggatagcacgggaactatatttttatctccaagtttgcctccaagtccagctgtgtagtgaaagggcagcaggaaacttcatgaagtatgccttcagctcagagtcagaacccgcattcagaactttgctggggatgagagaaaggtcaaacctgtgggttaaaagagaaagagagagagatgagaaatttacagatttttatgaagaaagctacaataatttgtgctctggacacagacggacttgggttagggtcctggctgtaccacttaacctacataggcttagtttctatattaataaagcagggctgatggtgaatataaagattttaaaggctctagaatatagcaggcactcaaaaaatgttacagttattattccaaagaacatttggtgacataaaaacatgaggataaatatcatccaggaaaaatggaagattctgcgtaggtgatagtccaaacaccattcagaaagccagtgcatgggcaaattgctttggagccacaaaaagctaggaattaatgacgtcttgggcttcaaggaaatagtggggagctgatctcccacaggtgtgggagcctatccaaactctctgttttcctccgtgtcctctgactgatgcccaaatccaacctggatgacttgtcacacctgtgacactagcacccacccaactctgatactcaccagtttagcaaggccctcttccatgttcaggtacctaaactccagaccccttgggacacactgacttatactttggggcactttgtcccactggaagaatatgggagtagggagaatagagaacaatggtaagagaagcttactctcccagcctcatcatctccggctttctctatcactgaaccctttcctcatagactctccaggtctcatgagcttgattaggcgactcatgaaaaattctcattactgaagcctgagatttctcctttgcctgccagtcaccctctgtctctccagagtcagaacgtttgcaatttccatctcaatgattattttaacaagtgaattaggtttgttgcccactctgtagatttaggaaggacccttatctatgagtgatttcggtctcacatcccaaaagtccacatttctacttcagcaggccacatcatgtttgttccatggttcagaatatctgaacttttagtttagaactggctggtggggacctggagttcatgcaggcagtctgctctggagtctgcgtccttattcccattctagtccacatccctctaactagagtggatggggaggggagaggaatggaacaaaaaaggtaggttaaagttggattgaatagaatcttgaaagctaaaccaaagaattagaatcttactatgtaggcagtcggaattcagagagattaaacaaagtggtttttgaggaatagtaattggttggcagaacacaggattgaatagaataaggaagatattaaaagattaagagactgtttagaaggtattacattaatctaggtttaacaagatgaaaactcagcctaggaggtaacattgggaactaaaaagaagtgatgggcatgagccagttaacatcagcatgacctggtgggtgattggagtggagagtaaaagcgataagtctggttttaagagtagatgatgaggagatctaattacatacacacacccataactaaggagttgtatctgataaattatttaatctgaacctaaatatttttattccttaatttaaacctcctcccttttttatcttcagcttaaacattgctgtttaaatcctccttaacactttacgcttaagactaaatgatcctgatattgttttttctcattcctccacttcttaaatacatatatatatatatgctaattaatgggcagagttggtatgcatgtactgtctatatctctataggtgaaagcaaaaaacggattctggagataaaaataagaatgatagctctcctttattgaacacttattatgtacctacttctgtgctgagctgctcatatgtattatctattgaatgcccataacaaccctaagaaatagataccattattgtcttcatttgcccaggaggaggctgaggcttggaggagtataagaacttgctgacagtcataacatctgaaggggattagaatatgtcacgccaaaatatgccactttggcataataattattttaagttgaaggcaattgagaaaaagcagacacaagaagagctcttttccctcccctatctgcctaaacatagggcataaagctttcttgtgaaagtatttccccaccttccatatcaggaaagggataacaaactgtaccactggaaatggagacagcacctaaataagtctgtatagacaaaccttactacataacctttatctagcagttaatttcccccatatatttaccttcccacaatttgccactcctagaaagccaagcccctttcttttgtgtagtcacttctccataatttatcactctttgttaaaatggtgtataaggccaagtctagtcacttctttgggctgtttccttctgtttcttcaaagcccatgtacatgtacaaagattaacatccagtaaattttgcatgcttttcttctgttaatctgtcttctattaatttaattcacaggccccaactacagaagataagagggcataggaaaagtttttcctctctacaagccaaaagtcgcaaggctaatatttactcccctgattctctcctccagagcccacacccttcatcactactgataaaggtatgataatgaattctaaattcctttcttaaaatctgctaattgggtaaagaagtaaagaaaagtttgatattctcctccatataatggcttatttatagctataacttacttgtcaaatacaaatgctaccgtggtactatttatgtgacacgtgatccaaagactgttaccacacactacactaaaacatggatatgacatatttcctgtgaagaagaatttggtatgatttagaaaatcttgaatcatattcaataacttaattttttatccaggatataaacatataattgtttcaaggtataaactcctgtacagaatgtcagtgtattatggcacaccccataaagagactgtaaaaaacaattatagttttatgctcaattaaagagacggaaatttttaaaaggggctatgtcaatcagaaagaaaagtacctagggctcattaatttaaagacagtaattgatacgctggcttcaggagtgtttttcatattatcattaatcaactcttcatttgaaaaacacacacgagggaattactgaaagagtaggtatcacatttaattttttccactatgtttttcctagtttcaaatatgtttttcaaatctggcattcatggttgctactgcactggaataatggtaacaacaggctgatgagaatcttaagtggcacttactcagtggagtaattggaagcggcaatggttatacaaatgaatgcccctcagagggaagaaggagagatttgccttgaaactgcggctgtaaaaagttagtgctggtaagtgaagaaacagaaactaagtgatagagaatgggaactaaggtagaaataactaacaaagatcactgtgcagaaccgtagtggtgttcagagtagatgcgcaagtccatatgcatgtagcaaatacaagtctcaacccacaaaataaagtgaagatgaatatattttaattttgttaataaagttattttaatttctgttataagctctcttccaccaagacagaagcacggtcacatgcctgggtaaaaagaatatcccagatacccaagactagacagcatgcaggggtgacaggcttattaacttcacactcactgggccatcagtactttacttataacctcattcatggttttgaagttttaaaaaaatgttgccaccttgttattttgttactcctctcttataagtgattttcagataagcagaaacacattaaagggaaagtttatttggttcatttgcaaggcagagtccatggatttcttttggctatccctttttgcactttcaatggaacaaacagtgcaatttttatcccttctgtttttagagcagcagctgtaaaagtaattaatggctaaagagactctagcacatcctactgaaaggccattctgggttcagcaggagctctggaccccaggctcctgcctctgcacgttcacagacttgcagagagcactctgatgaatgctgaaggacccccctcccaaacttgggatctccgcagcaccctgatccattttgaccactgccacttataaagaaaactggtgtcaacaggtgttttcatactatttccagtgatgactttggtgcatatccagtattcttttttttaatctctgggagttgacaatgttctcatgaattctattaaaaaatgagcatttcccctaatatgttttctcttcctttcagccttcactttcttctttttgtctctaccttccttaaaatagcattgtgcaaaaacatccctgaggttaaataataatcatgtataatgaggaagcgttctgtgtgtgccctctgcagagtcagaggcctgatgtgggactgaaaacacaagctggcctccaggcctggtgagggtcatgctccctgtgacctcgagtcaattgctcgacactttggattctcagttttctgatctttaaaataaggatgacagtacctacctgggctacttcacagtgtccttgagggatcatgaaagtgagtgtattttgtaaactgcagtgttccatagggacataaggaatgttggtcttattgattttgttagaacaagactcttcagaaacagtggtgagagagaggaatcagtccgggattcctcttttccatctcattgactcatctgataacactgagatagtggcttgctgctgcatattccctagcggactgagagaacacacatttgccaaatatggaggggaagatgagctttctgaacaccctcctattgtctgcactggagctaagccaggccacatcttcaggataatgatctgaggacggtcaggctcaattcattctgcctgagctttgctgctgccccttcaaactacttacgaaagtggtattaggttgtgatggctgctgccccacccttgggagaatgcccaggggatgtggactgccctaggcagccacaggaaactggaccagaaagtgcagagtcactgtgtgcccaggcgcctgcaggcagatctttctccaccacatacatttttagtgggccctctcacaaatgcctgatatttaacatttgagaaagtcagcaaaatgttttgttagtcttttattcaccattttaagaatataacgtttatccagttggtgtcggataaaatcgggaaagaaaaatatgactgcactatagactcagggcccaaaattattctgatgatggccaagtaaaaacattaaaagctgaaaaatataatagcatccaggatattactgaagattagttttaagcttaagtttttttccctcacttatccagatttgagtatgagaagatttaaagaattctataaaaactgtgaaaatgcatctgctaaattaataacagtatttatttcacaaaaatgtcctaagttttgtaatgcctctaaaacaattctcaaacttcttggtctcagtatccctttaaaattcatacattacttaggaccccaaagggcttttgttcatgtaaataatatcaatatgtatttattgtattaaaagttaaacctgagagtttttaaaaatttatttactaattcatttaaaattaacaaaaacaaacatactacctgttaacatcagtgcaatgatgtcgtcatattgatgccggatttcttgctccttagctcagctaggtctgggttcttgtctcatgaccaggaagaagtaggcacctgggcactcttagagtgagcaaggcaggaaattttattgagtgatgaaacagctttttcaggaaggggacggggatggtccccctatccaaaggcaggagagttctcaatataaccgagcccagggctttttaagggctcagaatagggagtgtgtgctgactggtttgtgagtatgcaaaaaaggtcaaagcaaagatgccactcaaaggtgggcacgacattgtagaaaatcaattaggaaagggtaggtatgtgtaaaatgggtgaagggtggagatcaatcagaggaaagcacaccaaacaggaaagcgggttctcaatctggttcgaggagttaacttgtagcttggctttcaggctttaaactgtctttggcttggacgtgggatttcgctggggacccgcccctacatgcttaggcatttggctgcctcctgctgctctcaatatttcatatagctatggaaaaactctactcataaggaaatgagagtgagaagggcaaatgacttcttagtgcttgcttgtcaagggcttgtttgacaatgtttgctctaaaatattttgatctccatgaaaaaagtgttaaagaaaatgaggaattacaattttattatcctaggatttttaaaagtctgtttcattgatcttaaaaagtatatttgtattgttcaaattgtgggctatgagtttgaatcctcatcctgtcatgtactggttgaatgaccttggacaagctatttaagttttctggacttcagtgtcctcacctgtaaaataaaaatgataattgtataccttccccttggggatgttgtgatgagcaaattacttaaccttatgtatgtcatggttgtctagagggaaaaaaacatatatataaaatattggatatgttctatatatgtgtgtgtgtgacagagatacacacacacaaacacacacacacacacacagagatttatgttaaggaattggcacacgttacggaggctggccagtccaaaatctgcagggcggactggcgcctggagacccagggaaaagccagtgttgcagctcaagtccaaaggtcatttgctggcagaattatctcttgctccagggaaggttaatcttttgttctgttaaggccttcaactgattgaataattatggagggcaatttattttgctcacagtccaccaatttaaatgttaatctcaaaaacaccctcaaagtaacaaccagaataatgtgattacatatatgggcaccatgatccagccaagttgatataagacattttcgttgaccaaaaaagccaaactctataaaatatttgaagatatttattctgagccaaatgtgaggaccatgatctgtgacacagcctcaggaattcctgagaatatgtgcccaaggtggttgggttacagcttgattgtatacactttagggagacagaaattacaggcaaaaacataatacatataagattcacattggttcggcctggaaaggcaggacatcgaggggggccggggagtgtgacttccaggtcataggtaaattcaaagatttcctgattggcaatttgttgaaagagttaggttatctaaagcaagcttgtccaacctgcagcctgcaggccacatgcagcccaggacagcttttaatgcggcccaatacaaatttatacacttaaaacattatgaaatttttttgtaattttttttttttaagctcatcagctatggttggtgttagtgtattttatgtgtggcccaagacaattcttccagtgtggcccagggaagccaaatgattggacactcctaatctaaagagttaaagtcagcagaaagaaatgcttggggttaagacaaggggggctatggaagtcaaggttcttgttatatagatgaagcctccaggtagcaagcttcaaagacagtgatcatggtaaatgtatcttatcagatcttaaaatgtgccaaactcttaattaaatcactcaaggatcaggaaaagacctggaaagggaaggggattctctacaaagtgtaaattcttcccacaagagatagctttgcagggccgtttcaaaatatgtcaaagaaatatattttggggtaaaatactttgatttctttcagggactgccatctgtcacgtgatgctatactagagtcaggttggaaattggtatcttattgctacaaagagtctgtttcctcagtcttaagatctctgttttaatgttaatgtgagtcgatggtgcctgaattccaaaggaaggagagtataacaaggcacattcaaacctccttcccatcatggtcagaactagttttttagatttctccgaaatccctttgactgagaggatggggtccattcagttagtaggttggggggctcagaattttatttttggtttacactttgaatggtgcccggcatatacaaactctaaacaaatgttatatattcttaatattgtattgaatatatattgtttttaggtgttgcatgaaaaaatcaagtaatacgcaaagcaaatttttatttttatggagaaaaaaaccataaaacccaggaaacaagtaataaaggttaacatggctttttatacttaataatacttcatattttgaattaatatataagaagattcagaaaaaccagtgggaaaaatatgtaactgttgatgaaaagagttaaactccgtacaatatttgaagagatttattctgagccaaatatgagtgacgatggcccatgacacagccctcaggaggtcctgagaacatgcatccaaggtggctggggtacagcttggttttatatattttaggaaggcatgtgacaccaatcaaatacatttaagaaatacattggtttggtccagaaaggtgggacaactcaaagtgggaggctttcaggctacaggtaaatttaaacattttctggttgacaattggttgagcttgtctaagacttgggatggatagaaatgaatgttcacgttaaaaataaaggattgcagagaccaagttttattgtgcagaggaagctctcagatagcagacttcagaaagaacaggttgtaaattgtttcttaccagacttaaaaggatgcctggctcttagctgattgtcttctggatctggaaagaaaggaaggaaaacaaaggggaaaagggattctctacagaatgtggttttttcccacaagggactttgcagggcaatttcaagatatggcaaggaaatatattttgtggttaaatattttttcctcatcttataatgttatgccagaatcagattgaaaagtcacaaaatatagggtcaaatgaaatccatctgatgagaacttatggtttgtagggcatgactccctagaccccttaggtaggaatttgggtaacataaaaaaatcagagcttagtcctcataacccagaaacaaatcttatcatatacagtgatatgataaaaattggcatcacaatgtgaaaggtgagttaatcattcagtaaacagtgtttaaacaattgttaattatttgtttaaaaaaattactttatatcatcactttaaccaaaaaataaattccaattctatttaagagtgaaatgctaaacatacacatacacacacacacacacacacacacacattacagaaaataatttataaatttatctatatctatatatagataaatatttagcttatctttgggtaggattttaactcagaaatcattggaaatattactaaaacattaaaacattgattacattaaaattaccagtgttaaaggtaacaaattgtgaaagaacatctacgcaaatgtaacacagaatcgttagtatatgtaaaatattgcaggcttacataaattgataggagcaatataagatcccactggggaaaaaaatggcaatggtatcatcctggtctgtcagtttcctttgagtcacaaggataatagaagtacagattctttaaagtaatggaaatttatgtagaattcctcagaatgcagagttagagagaaaatcatcccttaagtaacagtcatctgggaccccaatgtcatcttaactgggataaagtgttggcttcaaagacaattatgagaactgtcttgtttaggacaatctcttgtttgcctttcatttgtacttcataaaaactgaacatgattaaattgtttggtaataatagatggattgaagaaattgattcatgggaatacattttggactagatttgtcacacccacaaatgaaaaatggatattttctagactttcacttattttaattgatgcacaatggcttatttaaaatgtttcagccttaatcctccctctccctgctttttgtgagattttctggtctcaccaactacagttctttccaggtttggggatggaaaaagcgtggtaccttttcatcccatcataagggtcacagccaacactcctataacaaaaaacaggttaacatgagaaaagcataacacatttctttaatcaaagttttatatgacatgggaggcttcagaaatgaagacctaaagacccagggaaaactgtctatttttttgcttaggatcaatgaagaatggacagccatgtagaaatgtgattggaccaaaggttgtgatctaatggtgataggttgcaggggaaacccagcaaggcctgactgttcagattcttcttggcctctttgtgtggtatttctttctcctgggtatgcagcaggacccctctggaatgagggtcttatgacctgctttcaagcaaggtaggtcagatggcttccttgtggccagctcctacacagaaagtttagagcaatatttctagtttctatgacccaccttgggaaagaggaattctagtttctatggcctgccttggggaacaggaaaaagaaaggcaggagaaagtcagagacagactttgattctgagacccttccaatgtccttcggtttaaagcactcagcatgccaaagtgccatgctgaggtggttcagaaaacccccaacacaggactgtgagctcatggctggtggggacttactgtctatgtgagtctgtgcctcacacaagtgcatcacacccccatgcctcaacaccacatgtaaagacaactcccttgaaggattaattggcactttaaaaaggatgttggaacagagaaccaaattccggatactttctttcccctactatttccacaagaggcaccatgcaggttgactcttagccctggttgtcccaaaccagaatgaaaggtctggcttgactcatggagattagcttaggctgctgggcaaaagaaccaaaccctggtcctgactgttgcattggagccttctgtgtggtctagtggagaaaatacttgctgggagccagaaattgagatctgctccttgtccagtcttcagagcaggtggcggggccagctttgccagagtccaagtggggcacttatgtttgcagccttcagatttccctaaaaatagcaagacctctgcatccatgtatcttttggttgagtctcagtcacttgtaagcttcaacaattaaatttacctccctgaacctcaatgttctcatttataaaatggaagaactgcttacatcatgccccttaagaagattaaataacattgcactgcgcacatagagcatgtgtttggtgtataataatctcaagaaatgaacttctctcccccttaagcttatgtcaccatcttgtttcctaacagatccatttttgattaattttcagacaggaaaggatcatatatattcaaatggtgttttattagctaataaggcaaactaaatgttctctcccaagcatattggtattttaatatggaaaaatgggaaattatgctgtcatggtgatacctgaggcagcgaggagaagccaacaaggactgtatccagagattcaggagaaattatccaagaattctttgcttcatagcatttttgaatcaatcttttgatttaagccttctgaaacttaacttgccaatattttgaaaagtgaactatcaagattgttgtcaatcacaccctagtgtggtttaactttcagatccctttttggaagggaagttttatttaatccatgtgttgagaagaggaggatgcagttcatataacctggatatttagagtgaagggagaaagaagatacagtgaatatgaaatgaaactttcacataattcacacatgtacccagagttgcaaggagaaaacaaaagtattggtacataagtacttttacgtgaaatgatttaaaatgtttgtatatggtattttttgttgtagtttctgagatggagtcttgctctgtccctcaggctagagtgccgtgccacggtattttaatttatttttctttattttgaatttctctactcaaaggtacattttaaatacccttaatcatcatgatgatcccacacttcctgcagattcccatagaaagtcacacatcttcctcctgttgaactattgctccacaaatcatagtatttgcctaggattttgctttttaaagttccattgccacatttgtggtaaattctattgtgtatggtaacacatgataacaacaatgcgtagcgcctaaaagctctaatgaccagcaattctgtggtcagtaaaaggaaattacataacattagtagccaatatgctgttgagggaaaagtcctcacatttctcctgaccatccctgcccctgtcacttgccactaatagtaggttttgcaactaggtttgggggtgagtggaccctggagtactattctctgtacccccaaaccatgcccaacccttctacttggttatttcaactcagtggtggtcaagttttgttgtatttaactcctacacaacttcactctgtctgttctatcataaaccatgtgtgtctagtactatcaagctaagcattttcattattactttatttacataaaacccttttaaaagaataatttgacctaagatacaggtcatcctggactttccaccatgtatgtctgttagtggtggtttgtcttttttgggggggatattttgttttttgtttgttttgttttcaattttttgagtatttactatttaaataaaaagcaatggcagcaaaggtttctatttccatgtccctttgagctttttccttgacatccacttctctcacaaggatctggccttcatgccaagtctctgctgatcttcactgcggagggcagctcctcccaggagagggtccagcccctccattggctggtgccggcctcacatttgtcctgaccctgtgtctggcttgtgctgcccgtgattatggctcctgccggccgctcagtggcccatgggattgtggagcagaaagcagaaaaggaattttggattacgggggggaaatgatgctttaaaaaggcaacagttttctgatgtctatttttttttcattctaagatagtttcataaatttcctcttcatttcaaccaagtacgcttggttacacttcctaaggaattttgttcaactagatggtatgttttggtgaattaatccaagaggacgctactgaaaaaatattatatatatgcagctttcttcacagaacatataacaggatatatatttgggatgttaatttaaaaaacaattttaaggttaaggaatgatatagtgtgctagattaagatgtattgagcaagtcatgctttactttttgttcattttactaggtcatttaaattccttttatgtgctcctcagggcagttaactctttacatgtttgattcagtgctggaaaggctataggtattgaaaggctctaaaaagttaagtgattaaataattatgctcattatctttatcatatttgatgttttaaatactgctaataattcatcttactttatttgcactaaaaagctattcttggatttaatatttctagtaataaaaaaagcaaaacagatattctctcatttgtgttcctcaaagttaattctttattatcttccttctcctcaaacatgaagttttatcaacggtgatgcattttcttgtgtgtttcttactctatcagacttgatccagtcagactcacacacctgagatgaaacccaggctcctggaagctatgaaattgttcagtaatgtagccttataagtaagcaattaaagcaggcctggagtccagtaaggcctatgccattcatactggcaacaggcgatgtattttccatcactctttccccttgcccagatagcttctctcaaaatagatggtatgttttattctatcaagcatttatattaccttttccttcctagccattttaatggaaatgggtggagaataaacagtaactcaataagaagtcataattgctcattgtagtacatcattgattgtgtgattttgtaatataattgttattgggctcttattgactggattctgggtttctcctgtccttgttaggttttgtgttgactattttctctttctatttttttcctaagacttttaaagtgtttctcaaattatggtctttgttaaactttctgcatcccgtaatgtggatgttcaaaagattcctggtccccactccctacccactgccaacagaatcagattctctggaagtgcgagctagaaaaatacattttgaataagtactcctcccctccttaggtgcttcttatgcatgctgaagttataaaaccattgaggaaaatagacccaccagcatcatctgaaacacaattatccttccaattgtgtttttttccccctacactttctccttttttttaatctatcatctcttccattttcaagacgatttgtgagtcaatgtaaatctgtattgctgggccctatccaccaaatctacatccagccttagacattaccaatatcaggaatcatctatggaaagattcaggcttattccatagccataaatcctggaaactgtccttagtcatttagcacagtcttagaggaggcctcggcattctgtggctagtattacaccatcctttagcatcatgaatgtcaaagttgtgctgagatgaagtgaaatgtacctgaaataacaaaaataaacaaaccaaaactacttcctacttgttgagtttctcctacttccaaaattactctgtttccaaaagttccaggtcctacaagtgctctagattctatcctatgcctctttcccatgaggcttttggacatcttcaggctgtagttctttttcctactcccctacccttagaacatagtaagtagttaaatatgttcttgttattatgctcattctcattgtgttatttatacatggcaaacacaacggtgtcttgcacatgtggtctataatctataaattttatttatcattataaataatcttcaaaactatattcaagtaacatcttgggtaacagagcatatcacagataaactgtgaaagcccaacacctatttaactgatttatcaacatgctggtggatacttaaaggatttggagtttactacatattaaagtgtatgttatgttattatcaactcaaactaattaataaaattagccaggtgtggtggctcatacctgcaatcctagcaacttgggaagctgaggcaggaggatcacttgaggccaggagttcaagaccagcctgggcaacatagcaagaccgtgcctgttaaaaagtaaaaaataaaataattagccagatgcggtggcatgcttctgtaatctcagatattcaagaggctgagatatgaggattgcttgagcccagaagtccgaggcagcaataagccaggatcgtgccactgcactccagcctgggcagcagagttagacccagatccttaaaataaactaatagaattttcatcaacctagttcttcctattctggcatgaccagttcagaagtttctgtcctactttagtgtgtaatcatattatttaaaaataccataatttttaaaggtgggtgtttggtaactctgacatttagtggaaaaagatcaaaacaaatccttccttcgattctgggcaactaatgtccacccatcctatgacttttatccagtctggcccatctgcatacttggctagcttttctggtctcagcacgggtaacttctctgttgagaaactttcctcatccagcaaaatctaggtttggggaagctcccacaggctctcacagcattctgcctcctcacaacaccaatgacatttgtcactgcctcctgggcagtctctgaatctaaagtgtttcatattataacttcagtaccaagacaagagcctggaacacaggtggatgccttgatcagtaaattaatgcaacctgtacatgtgaaaccaaaccctgtatactttagcatcatttatggcacagagagccctcttcgctttactctgattaagtggccattcattctccttttgtttggctcctgctcttttgttatggcccccagtttctgcatccattctgcaccatgaatgtatcagttaatttcagtaatcctggtcccatcttctggagctctcaggggactctggttcaggctcaacactctagagattcccagttttcacagctttagaacaatcccctgctccagcctcttaagccaaaccctgagggccccttaagagagaggaccaaacactctatgtccttatgggtgttttcaatctagcattctaacctccttgaaatcataaaaacacattttttttctttgattcattttatctaagtgtcttggacatttccataaatggatctgttgacaataactatgaacatgttttcactgaaactatctcactgatgagtatttggtggctttagaaagagaaatggttgaatattagcatggggtattaaaacctgaaggttaaatggatgaagaggacttgaatgaccttactgaggcaacaccgtgtgaaaaaaaactcttaacattttttaaagtcttctatttggtaggtccacagaaaggcattcatcacccagaactggcctttggaaggacacagacttatatttccatattttcaatcacaggtcaacaaagtttccagactttccaaaggtgaaaaactgtaccttaggcttgttgagtagttagagcagaaggaacaagtttgtcatttgactggtcagtaaacctgtttggtgtctggccagaccaaaaatattttttgaaggggagttctctttgccatgttattcttagttttggcccaaattgtcttttatattttgttggcatcaaggtgggctgccaaggagaagaccccagactctgagcagaccgctaggcagaagcaattggaagaacacaatgagcccttgatctgaaagaactgacagaagaattcagggagtgacaagagctgcttctatccaggagggctagtctgaatgcaacgattaagccatcctggggcacagtgcagggcgcttggtattgattcaatacatttttaaaaaaataagtgaatggggccaggtgtggtggctcacacctgtaatcccagcactttgggaggccgaggcaggtggatcacaaggtcaggaaatcgagatcatcctggccaatatggggaaaccccgtttctattaaaatacaaaaattagccgacatggtggtgggcgcctgtagtcccagctactccagagcctgatgcaggggaatcacttgaacctgggaggcggagtttgcagtgagccgagatcgtgccactgcactgcagcctggtgacagagcaagactccatctaaaagtaaataaataaataaataaataaataaataaataaataaatatgtgaatgaatgagaaattttatttatgttaaatttttgaccagagcatatggctctattactgagccagtcggaaatggctcagaatccagcagtcagcaacatcatactattcagggtcttcaaatacaccctccagtttgaccaacaattccaggaagtgaccagcaaagtctgcctttatccccttccattaagcacgtcaaggccagttttgtgaagcagttgattacaatccccaacctcaagcaaccagtggagaaacctgcagctgaatcccttgacaccactgaatatgaactaaggtgttgggcctggccttgtctgtcttacccttgaaaatgtacccaagagacaatttggttgggactgctgctatttgggagacctgattccaccctgggtagattttttttttagacggagtctccctctgtcgcccaggctggagtgcagtggcacgatcttggctcactgtaagctccgcctcccaggttcacgccattctcctgcctcagcctcccaagtagcttggactacaggtgcccgccaccacgcctggctaattttttgtatttttagtagagacggggttttgccgtgttagccaggatggtctggatctcctgacctcgtgatctgcccgcctcggcctcccaaagtgctgggattgcaggtgtgagccaccgcgcctggccaattttttttaagtgaaattaaaggcccctgacttcaggatgggagtcttctcttcttactgatgggccagcgttctcagtgcactgtctttgtggcaccatggctacagatttgctctgggctctttgtgctaataaaggcgaagggctagaaaagatggaccttgtaacatcttaaaggctctaagagacaattctgcatagggtaagaaaaaggaaattggacagctagacctatggttcttactccattcttaaagtggacttgttccttggataccagggaatacaacattgacatagtatagtccaatggctaaaagtgacctttctgaggagcatgatgcattcaggatacttctgctttgtgttaatgtttcttcccttctaatctattatttccaagctcgcagatcaatgaatagctttactatttaagattccagttgaagggggggaaggcaggaatgtaaatttgtagggaggagggaagagcaatcagccactctaaggtcccatgggagctggcaagcactggaccacagaatggaatgggatgtgctgaatgaagctctgtctgtcttgtacacaccagtcactccaaggagggagccaggaagcaggcggcagggtatgtgggctgtcagagtagattctgctgagaagacatgtgtaagggagaactattgctttaccagaagcgttgacaagaaatagaagctgagatgtcattgcaaaatagaatgcacccagagtagcatttgaatgtgaatgcaatcattggagaacctacggagaggccaggacaaaggagggaatgtgtgaagcttgtttgagagttgcgagtgagaaaaagttgtttgctgcgatgagttgacaaaaggaggatttttaaaaaacaactactactctttccaagggtgaccagtaactatcttagagaggcaaattttatgaaccaggccatgacgggaactgaagaaaatgcctgccaaagtcaaatgtctaaagtaaatatacttttcataaagaaagtacatagtatttgtgcattttataaaatatattttataaagaaaatgtaaagtacataatatgtgcatgtgtgtatttctttaaagacttatttatagaactagcaatcttagacttttttggtcaaactctttggtcatattagactatttaaaatacaaaaagaaataggcatattggtgtatatacaattttctagcattgcttctctaagtattctgtttctctgtcagtctctctctctctctcacacacacatacacaaacacacacacacacacaccatgcacaactattagcagaactgttgttttgcaaaagtttgatggtttttacttcttggaattgggtcctaccagtttgtctattgcccttctgggaaatgtgtccacctgtcatggatgaaaatattgcaaatgtgtcttctgtgttaccgaaagacctaagggggtgaattctattttgtaaccaagaaaagactagagccagttcttaaatgcttcttctagaattcaaataaaaacttagaacatatctactggccatgttgttctaattaaaatatgtcaatattaatgccaactattaccgtgggtacccacacagaagaaagtcaccaaaaaatgtgtgcagtttccatataaaggctgtttttatcactattttaatttaaaatggaatatggagaaatgcatgaaaataaaatgctgtttctaccttcagtatttatacttatcactcttggtactttttctagaaaccctttataggactcttgtgttttcctttccatcactctcctcactcctccagggcacccttttcttctgaaggccaacttgtggaaaccccaggagctagctaccatgttacaggaggctgaccatcatctggactctctcttatgtcagactgtggaatgtaaattttggaagtgccaggagctatagtttctatcatgtatacaaaacttctctgaagtgagaaagactgcaattgacataccaagaagagcacagacaggacacaaaggtatagtcttgtcagtgttcaagctcctggtcccacttatttctctgaattactacccatcctgggatttaattgtcctagagttctttgggttgcatgagccaacaaatgcccacttgtcctaagcaagtattgcttgggttttccatcatttcatcttctattctattcagaagattcagaagatttaacaaagtcctaggtatgaataaggaaataaatcttaggacagattatttccaggagcagtaattagaaatattaagctgtagccagacatgtccatggcatgatgtatagttaggatatgtaccattgaccacaacacaggtatggtggttttaaaaaatatgttgcaaattctttgacactgattctcttttcattaggtcagatctaattccttctccttttgactatggacttgacttagtgacttgtttctaacaaataaaatatgagagaagtgatgttatataacttttgagactaggtcttagatagtttcaactggctttctttctcatggatcacttgttcttggagaagttaacctccaggtcatgcagacaggcaaagaacctggagagaggcctatgtggagagaaaccgaggtcaccttcaacagccaacaccaacttgccagctatgtaagtgagccatcttgaaatggatcccccagtcccagttaaaccttgagatgattggtcaacatcttgaatgcaatcttatgagagaccatgagccagagctacccagccaagccactcttgaattcctaacccacagagataataaaatgtttacatttttaagctactaaatgtacgggaaatttgttgtataataagataactaatactatgtccaagattaagggaaattactttgaagaggttcgtcaattagcatcagtcataagtgacggcaggagatcccaaataggcaactcagtcataaaaataattggagttcatgattacaggtttggtccccaggaaatagagctccaggtagaaaacattgttaatgaagaacacatgggaatagaatcacttaatcatataaaaagagtgatagaataatataatggctaagataaagagtttgagagttaaacagatttagattcggatcttggctccactagtttctgtttgaacttattacttgtctgtattttttagttttattttgggatagttttaggcttactaaaatgttacaaaaattatcaaaagagtacctatgtactcgtcacccagcttccccaaatgcataagaatttcgcataagaaaaaacaaaacaaaacaaacaataacaaaaacataagaggcctggtaccaagtcccacgagtgactgaaatctcaatttgtattcatagaaagtctattcataccaccttatcctgttccctttttcttggtcctactttttccaggacacctgggttgtcctcttctcccttctgtgccaaactgtcctttcccattgaaaattaatgtattcaggctcacttctctctttaaaagatgcagtcaggagctaagaagccagcctgaagtttctcaacctccgtttcttaacactttagcaaaaacatttccaaaatgaatgaccctcctccatcatgccccacaccaagaaaatgtgagaaatggatcataaatttctcagaaaaatgataattcaagaaatttcaaaatataacaaactaccaatatatgtatcatttaaagaaaacattctttttgctctcacatcataaagtaatttgtcttcaaaacttgaatttgagaactattcagggcataaaaatgaagacatcagagtcacatcatatgtatgtgctggttgcctacccgccttcccatcttgaaggtaagcttcttgcaggcagagccagcatcctgagttctctgtcctgtctctaacacagtgcctgtcacacagaaggcatgttgattgactttgatatgatagagaaatttcctcttaagtattccatttttcagaattcattcaaaagtcaaatacccattctttaagacatcttgctaagaaaggaaaaattcattataaagggtcattttgaacattcagaaggaagacctaagtgttgagtaagtgaacagacctttctgctgatgtacttacagagacagaggtccgggccagttccccatcaccccttacccgcaatgttacaggctcttctcagagctttctccatctgggctctttctcggtagcttgttttcacatgtggctgcaagactgaacacagttaatctggtttccctgccttgctgcacagaaggccagtcaacagctctcttttgacttatctttaaacatttttttaaatgttcattattgaggagaaataaaaaggaagcaacagaggcacaaacagagtgaaacgataaggcctaggaaatcttacattgtacttttaatcatggaccacattctttgtttacccaacttgcctttgagaaggagtgtcgcaccctgtgctgggcatctgatcctgcactgctctgtgctctactgggtttatttccacataggttcacatggccttggggcgccatcatggagggtcttgttctcagtggacatggcacaaggcagtatcctcacatagtaaaggttcaatcaatagttgttgagttagtaaatgaatgactcatatggctaattttttaccgatctgatgggtggatgcaatccaacattgccaaagtgaagggttacacagtgggaaggccgtgggggtggatgtatttggcaggcggcagagagaggtacaggacgatcccttacattgtaaatgcaaaacattctcagtggaatttggctttcccacatagtaattatgtgtcatagtgtatacatgctctatagcttatttctcaaaacatatttgtgggtatgtttttgccaatgctattttcataagacatgtctcacagaaatggccaggagcagccagaagcaaaacccaccaagtcctgtttcgttcttgttctttctttgctaatatgtgcaagacttaagataactgaactcatacttttcctacctagaatagaattatcttataaattcttctgttagtctacaagtaatctgccttgatcctatggaattacaagccagtagagctgctgtattttgcttgagtgtggttaccacttggttggcacacactaaggatatttttgactctctctttgctgacatgagctacagagcctggttgagaaaaccctctgaatgaaaacaaacaaaaacctaccagaacaaattagggacaggggaacttggaagccgtgtaagagttgtgaaaccatcagaacattaggatttagggtgtccctttaaagtgttttagactttctgggaatactccctgggaaatgttgtgttttcacaaaaaagttgttctgtgcctgacagcacgaagaagcacgtgaagactggagactgtgagaatgttttcagcaagagccaatctggtagcaaaaggctaaaaattgcattttcacagctccgccagaatatgcaaaaatttcttgtccctatctattttatgacattaaaaatgatttaaggcaattgacacttctatttcttccaaggggaaaaaatagattttgtagagttctggcatatatcagtgcatgattgtttcagatcattgtagctggaatgggctgttgtaccaaagcttatctaatatactttgttcattcattcaaaaaatctttactgaatgcctgttaagtggcagacactgatctcttactgggtatatagaattcaagaggagagccatggtcaacttaatcaagaagcagttctaaatttttatcaagcaaccatagtgaagagacatgataaagtcaacccagttctaaccccaccactaaagattaagaaggaaatattttagtatatgagttaggtaacctggttattagtcatttagggtatgaaataggacttggaaaaggttattaagattttgaagtaatagactgaaacaatcagacttgggaaagaacacagatctcatttttctggattagctgcatttggttgcttgcgaggtgaagctttagaggaaaaggaaaaaggaaaagcattttggcaatcaggttacatgaatagcaggtttcagcagatctaagtagtcccaggcaggctgggccagaatgtccttagataatcaagtgcggctttactggtatggttattatcccaaaggagacctactagaacaggctcaactctgctgctgtacagcatgacctttggtgctttctcttttttatttctcctgtaggaggcaagagctacagcttaatggataagagcccatgctttgtggccagccatgcctgggtttgggtcctgctctgctacttaccagacagccctgtgatttgagtttcacagcctctctaagcctctgattcctgcctcataaaaagggcatggtgatcgtgtgatacttcatagagcgaaatgagcttagactaagcacttagcccagagcctgacacaaggcaaggatctaattctttctagctagtatctcttgcaaggacatcaaggccatttcttgttaatcaaagtgagccagctggcatcacgggttggaaatcccttagcaactggttagcactcagtacaaactcgcttaaaattggtatattggcagttaggaagttaccactaattctgtcacacttaaccatttcataatggtgatctatttagagcagtgattggaaaacaagaactttaaatttggtaaagaagctttatgttgctttatttgtttcagaaaaggacaatacctgagtcatgttctaagaaaaacatgagcatttttgaaagtaccctatgtggactgaatagtgaaaaaggaaaggcacgtggaaaaggacattattattttaaaatgctttgaaatcacattcaaagtcgtcagctaagtttcgtggtgttctggccactgagggactgccaggctctgtcttccttttttgcccatagagaccccagccctgcagtactggtagtgaggctcatggtagctcccactcactggactcattctgtcattttcaaaagatgttcagttcttaaaataaactgacaataaataacagatcaagtatcttatgatctaaaataattcaatggaaatttggaatgaacataaaactatatagatccccatcttccctggctgattctctcagattataaacatattaaacttatccccagcctaaagtagcctgcttgggagttggcagtctctcaagctgcccttgccccctctgctctcctccacagccaagagtacataagaagtagtcctccctgactctatccatttcctccactcccattcactgctcaacctcctgcagttcccgctactcccttaaaattgctctctacccagctagaggagagctggcagctcagaacttaccataggcttaaaggagaaaaacttgatccagccccaggagagctctacactatcctgggctgatatcaaaggaacgcaactttccaaccccatcagtgttcacccactaccaacccctgctctccaaggcaggaagcaggtgagctgagacaagggatgagatggaagcagtcatcataaaggaaaaaaaaaaaaagtgacaactctggaagtcacaaagttaccagtctcaagaggaaatattgattatcttttataaaaattagcgttcattctccaagaacccatttgtatttggaacaatctgaatctcaattatctgagttccttaaagctacaatgatcatattcacttaatttccataaatagatacacttgtttgctttacaatagcacctaggttttcattagagaaatttcgaggaagcacccctctgtctttaattggcttcctaattacactaattttatttgattgatatattaggctctggaggaaagggaaaagaggggaagagaggtcacaatacagtcctttattctcagctccagacagcacaggaaatcctcaattaaactataccacttccctcagcatgccataaaacccatgcattatatttaatatctttaagctcatttataataatggttttatgtgatgtggtgaagttaactcattccttctagactttcttttcattattattgcagaacaaggcatgcttcttgtgaaaaaaaaatcagaagttcagaagaataagtcctgaaaaattaaagtcccccgtccccccgccccgtcctccttaggttttctttagaaaacttccctgtgacaatttccctccatttggagaggcagacaagaggacatctcctcactcacagccaggacactgtgcatctcatatcgtgctgggactttttcttgacaggattgagggagattcaaagttccccaaaaccagagaggaacaaatgcatcaacacagcatctcagaccctggagaaagtccagccgtggccatggttttgctgtagaatgttttcttctaatgcaaagtctgacttagaacaatgtcttccttgtgccttccctttaaggaagggttggctggaccccgacaattagtaacttaggacaaagccttctgagttggtggccccataagggccagaaggaagtggttttcctacaacctctgttcctcagcccggcctgggccacagcacaggtgaaggttattggaggaagagttgtttcatctgggaggcttttccttcccttattatccacacctgagcagcacacaacctagaggctcaggtggatcatagttgtgggatgcctgtttattttgtggtgagcatctgagaagcgtcatccccacctccagagactgctcagctccccatgaaggggtgggccagttctgtctagttcctccactctcttccctgcatggtatctaggagtggcacttccccctgaactaggaatatctgaccctctgtgtctccctgtgaagcccgttgaggtgagtattaatgtctctgatctgaccgagcagcgccgggtttgcaagctcagctcccaaacagctttaagcttgttcccatccaggcagagaaagggagatgttagagaggcttgggaccaaaaatggagaaagaaggcagaggttcagggcaaaactctatccagaagtgctgtttatttagctgagtattttctctctcagaatgatagatgactattggcggggggcgggggagtggtgggcaggatccctgacaaatataccctcttcatatgccgccgaaacattcttggagattgtgctctaggaatccccctgattctgtgattttccacgtttccgtgactgcttgagggtagaattagaacaaatggctaacaggataccattccttacagctcaataatgctgattgtctctggattctgagtaagaaggaaactgggaaacatcagtatctaagtacctctagtgattgggacagaaatttagacgtctggcaaactttctttttctatttcttttttttttttttttttttttgagacggagtctcgatctgtcgcgcaggctggagtgcagtggcgcgatctcggctcactgcaagctccgcctcccgggttcacgccattctcctgcctcagcctcctgaggcaaactttttatttaaccttctcaaagaaaatttaattaattttaatgactttttagcctctgaaaattatttgcttacaaaattagcttaataataatgattacattgataaagatattattttagcactaaatctgaggggagaaaattaccgtgagtttcaaaatatattatttttgactacttcaaaagatgtttgaagtgttaaaattatttttacagtttctcttacacccagaatattgtattgtcttagtccatttgtactgggacaaaatatatagcaaaatacctgagactgggtaatttgtaaagaacagaaataaattttctcatggttctggagtctgggaagtccaaggttaaggcaccagcaggtttgggtgccttgtgagggctgttctctgcttccaagatgacaccttgtggctgcctcctccagagggaagtgacactaaggtagaagagcaagctcctcaaatgctgtgtgaagccttttttatgaaggcacctgatcccgtttaggcagaaaaagtacccctggtctaaccaccacttaaaggtctcacctcttaaaccatcacattggctacacctgaattttggagaggatgcattcaaattgtagccctgatctgtaggaatcagattattgatatcatgtctaagcggcccattgaaaaagtggtagacatttatctttcttgtgctctttcgtagtctaagtgcacgttgtacataatgaatactcaataaataatgaccagacctcttagacctgatttattagtgatttaaacttcataatttgcttttgtgtttagagaagaaagagaggaaaagttatgctgtttggagaaagcagcacttgagcttaaattctagctctaactcaagtgattttggacaggttagtaaactctctgggactgtatctgcttatcaataaaaggcagataatgatcctactatctcatagagttattatgaggactatgatcacacatgaaaacaccagcacaggacatgttcttagtgtgtacaaaatgccattcccttccttgcccctttacatggtacaattgacctgacatctacaggtattaacaagagttctaataaacattgaggcaatatgttctttccctgtaagtgacactagaaggattatatatgtaagtatatattcattcatatgaatatgaatgaattatatataaatatatattatgtaaatatatgaattatataaaaatatatattatgtaaatactatatgaattatatatattatataaataatatatgaattatatacttattcatatgtattgcatatgaataaatagaaacatttcattcatgagtatgaatgatttatatgaataaatatatattcattcatgcatccctcagctcatccactgagctttttacaaacattttccaagtacctatacctgccaaacaataaagtgaagcaatggggcttacaaagaaatataaaacatgatccttccttggaggagcatcttatgaatcctcctcactgtcagccatctgattttctactgtggagacaatggagaagtagaccaaagatttgggggtagggactggtaaaggtaaaaacagaagaagtccacctttgttatattcttgaaagctgattggtatgaaaatgaagatttttgttaaaaagtaatagaacaaaattatcttgtttataatggaacagaaaactgtggcatcaccttctgtctgcaggagttaagcaaagttgttatccttcagtttgaggaatatacactgacattttcactgaagtgaataatgttttgctgtttgtcctagtataattttttgagtgtttctttaaattgttcttgtgtgagttgacagatattttccaggatataattactcgatatcatccaattcataaactcttccttctcaacaaatgttctcatcattgtggtgagtagcatcacgtccttgtacatttcctgggtgtgttaatattgaaggcaggatatgcccaggctggtggcttcttcagttttctttatacatttttgctatcttttgagaaagtctttttgcagctttaaattttggatcaggaacacagtctgtaccttgctcagacatacctggtgctgacctactactgaataaaaaacatttggacttctgtttttgcctaacttggaaagggaaagaggtatttgttagagttgtttcagaatgccaaaggggatagcataaacaagaatattcccccaaattcctttctgctccctctaccacccccgcaatgtgggagggagcttgattctgacagccgtctgcagggaggaatttttagccaatctcacctgcagttatctgtcactgttggtagcatgatttctgaataaggagatggttcctttttaatggaaaaaaattctttatatcccaaacttggcatgtattttagtgagaaaaaggaaaaaaaaagtctgataatgaaggctatagttggtcttaaaccctatttttggccatagcacaatcctaactgatccctaaagactgcagtccccagtaggctgcctttcctttctgagagccagtacagcccttccagaaggtctccactgacttcgtgctgggtgctagtggggctaaggagtagcctttatgccacgctcaggctacggctgcagcagtcccatggcctctgggaagtacttgcctccttgccatttttagttttagtctcttgggtaaccatgctcctgcccctcaatttcttggtatgggggtctttgaacaaggcagtcctatctgatttctcacccagtggtctgagatctcctttcccttcttaggttcagaacaagcgaatagccacaatgaaaacatatcagaaattaacttcagtttgtctcttgctcttggagcaagtgtaggtgttaaaataaaacatgcaaaccaacaaacagataaataatgcattaagtttattttcagtttttaaaaatcatcaatgattctgtattttttttgtcaatgaagacaattttgagagatttcatctgcaaagcagactgcatcctgcattaatttttaccccctactcaggtttctcttcctatcacacaaatatatccccttttactatagtaatgagtgttttctgttcttcttacttaacaataaaagtaacaagccactagagcattcaacagcacaatgtagtaaacagtaacttgctaagttaataaagttccaaccaaaaataaagaacttgacaattttattgctctgtgaagtcttatggtttcaatttagcttttgagaattgtaaaattgctctagaaactgctcccccacccccccgccgcattactgtgggatccctagttagaatttgtcaaaatggatttaggcttttaccttcccatttcctgtagcagcttcagttttcatggtttgatgttcaccgagtagtcagaaagatacaaacacaatgtcctgtgatcttaacgcaagggtgttctattgccatcatgtgtatcaggatttttgtactacatggcctgggacggaaagtacaagagaaaagagggtcaggaagagaaggacctgaaccaaaagaatgagcaaaatttgacttccccctatagattttttcactctaagtgccattcacagaaatttggtatccgtggaaaccaatgcggtacatgctgaagttacattttctctgcagatacaaaaggctagctatctaagctgatgttatgcttagaattagcagagagaaagtgtttgagaaaagtatagaataattaactggatacctatcatgtgcagggaaccatgatttgtacaatgaaggatacaaaatatacaagaaaggatgatagatatgggacaatttatttccatgtaggaatgttgacaacctttagcattctggctttccttaaatttataatgttacctatgaaaatacgagaaaatgttcctgtcacagatttagattatatcctctgctttggtaaaaaacaaaatgttgtcaaacagaagatggaattttcctgagacttattttatagttgaatgataaacaagaaagattcccagaaattgaataagatcataacaaccttgcaggctgttgaccagaaatgaggcaaagctggggacagagggaaacaactaagagaagcgagtgtttgacagcatgttgatttaatcaggggtaaaagagctgccaccgcaataagaaaagagtgtgttcagaggaagaaagtgtgaggaacgatttggaaacaagaacccattcaacgaagttgacgtaggttatgaccaggaacgggaagttcatggcgacttctgtgagtcaggggaggtgcacccctgggcagggtagatattcactgtgctgcaattctgccttaattcaagggtaaaccatagagaagccaactaaaagtaactttgctttctttactatcagtagaattgggtgagagagtgctggcatagccttggggagtgagcctgggtgtctagaaaatggtgaaaaatgaaagaattaaaagcttaacactgttctaattggactcagggaatgatatgtttggatcagttttacgagttaagaaactagatagtttcttacccctgctacatattcactggtcagcacaagtgcaatgtgagtgctcctttactccctagcaaacccggagaaggtggtaaagtcaggattgattggaaatcctgcagcatgggaaatgtggggttggtttgtggcatgacaacaagcaggcatgggagacactgggggaaaaaataggcaacgctagagaaaaatgcatccacgcttccaacctcttgctgaaacgtattcctagttattctttagttctgagaatcaagaacattttcttgttgacgatgtctacctcaataaataaggtgaaagtaccatctgaggcactttaaatgctgcacatgtatgtacgctaaacattagaaatagttttcaagttacaaaattaactttacatgtgattcgtttaacataatttaactcaaacatttcattttaagtgttacaaaacacgtcagttttagccaacatggcagatccgcactatacccaggcatggccccttgcttctctctttaagcatgtgttccaggttgccacaatgtgattgtgagtccgaagagaaaagtcaccccacagctctgtggtctttgccagaaggattgtgtagtgtaagcggtaaaatctcaatcgtttctaggtggaccggataatatttaaagctggtcatcaccctagacatgaagcacaagatgcagacatttgttctatttcttaaatgattggttaaagccatttcagaatgttaagatgagagatctgaggtaaataaactgtctctgctaagtatctgtttctcagggagtgttggtaaataagtatttggtttgctatcactagaagctcctatttttcattttactgtctacacccaactacaccaactctgcgtatattttaattgttcttccaaggtccccaaaagaaatataatgagggaagttcctgctgctagcaaccctctctgagacataatgtcttctagctcttctttaatgctaggtgcagcatctgttttactgccctgcccatcaaaatctttttccttttgcaaaagaaaagcctcatgtcttgatcattcaataaagtgtccattttctttcccttgagttcacataatctgcccggtttaactgctgggttattgggtatgttgttgtaaggacccccttttagtctctttgaattacatgtttgacttatacataacttctccagcaatctcttttcctcatcaattcagtcattagacaactatatattgatggtctattacatgccaggtactgtgctaggtgttgggaacacactgcacagctttttaagtttggtccagtggcctcaaaaagcttactacctaatagtggcctgttactgaattcttgagaagtatttggatggctatgtatgtgctttctgaaaatacaggtaaagtatttccctactcactagaagactcctaaaaaacaatgtgtgagttaaacttctgttaagtggaattcaggttttttttttttgttttttgagacggagtcttgctgtcgcccaggttggagtacagtggtgcgatcttggctcactgcgggctttgcccaccggggttctcgccattctcctgcctcagcctcccaagtagctgggactacaggcacccgccacctcgcccggctaattttttgtgtttttagtagagacagggtttcaccgtgttagccaggatggtctcgatctcctgacctcgtgatctgcctgcctcggcctggaattcaggttttaaatgctgtatacagcttgctattttagagcctcctgcaaagttaataagcaaactctgatttttaatatgaattttaactttagcactgatacattttcttaatgttgatcaatattataagcactcaaaactctcaaacattttaaaatgcataaaacgaaaacctttgtaaatggaatctctatttaaatgcactaagagtaaatgctatttaaaggaatcctgatataatattgtaaggaaagtggttaatcattaacttattttttaaatgtggacttttattgtaatttctatactgtagaaagcaaaacttctagcaatacaaaaaatgtaaccaataagaaaatacaaaatatacttcgttataataaaaagaacacacgagtagtaggctacatgagaccctttacctgttgtgttctgaagaagaaacctttccccagagcgtctgcctcagagtctatgttgtggcatgtattagtttgttggtgcagccataacaaaataccccagatgagtggcttaaataacagaaatttatttcctcacagttctggaggctaggaatccaagattaagatgtcaacaggattgatttcttctgaggcctctctcctgggcttatagacggctgtcttttttttctgtcttcacgtggcctttcttctgtgactgactgtgtcctaatctcttataagtgcaccagtcatatcgggttacagcccacctgcataacctcattttaccttatttaattacatctttaaagaccctatctccaaataaagtaagattctgagacactgggggttaagacttcaacatatgcattttttggttgagggagggacatgatacagcctataacatggcacatctctagattagaaaattccagtttgcgagtaaatagccagaggagtcacaatgcaaactttttttctcctataaaaacttcagcatggattaggttatcagataactgctatgttcagaataggcatttctaaagatttgttgatgatatgatgacagctctcaccttgaagagcagagggtaaaggaatagaaaatgaacccagaaaatgggtggaagatggggttggaaaaatgccagaaggcactgcttcaagaaggcatgctcacagtggctgagtggagggcaggggagggctgcagatagctcctgaagcctgcaggctagcggggagctcagttacacaagatgaagggggtaaccaaagccaggttgtgatttacgaatttgccctgatggagaatatttgatgataagcattaaatagcaaagtttagaagaagtttttttcttcttgttttccaattgttctttctattggacagtttgccatgattctgagctaaattagccctttggagacatggtcgtaagatagtctgttgatctggaaaacagttttcatgaaaaatgagtaggtggtagaaggaaaagagaaataatttgaaatgcaaagcactgtaaatgcatacgagaaaaatgcagtagtagggctgaatagcttttgctcatcaaattttaagccattcattcttaatgtatttggttgttaatgacataagttacgaatcacagtagccaataaatatttgtgaacattatttacattatcattatggaatgactttttggtatggtaaatgagtaacaattctttttttttttttttttttgagacagggtcttactctgtcactcaggctgaagtgcagtggttcaatcacagttcactgcagcctcaactttcctgactcagcttcacaagtacctgggaccacaggcacatgccaccatgctcagctaatttatttttattttttgtggagacagattcttgctatgtcacccagactggtcccaaactcctgggctcaagtgatcctcccgcctcagcaatcccagagtgctgagattacaggtgtgagccaccatacctagcccagttctgttttcaaagggattaaaatgtgctctgactgtatcactatcttattgccaacagggaggagaattcagatggacaatagggttataatgaagtggaaagaagttggtataagatacagcatcagttggcagaaatgacaagttgctagatagacttggatgggtggcacatgccagagggtcaggtctaggactaggtttgagaagagcattgtactgggaggaggggctgagagcatgaatgatgaactgccccagcccccactgaggatgttagagattaagtctgtataatcttttgaaagccttaaaaatcctgaattttgaaactctgtactacccttcagaaatctcacaaagtctgaactctaaaaccctggtcccaaaggttttagataagaggttatagacttggaccagtttccattcccacctgcagtgtacagtagttcccttggccccatattctcatccacattttttatagccagactctctaagttttataaagctaatggagatacattaatgtacaattgtgtatctcattatttttatacaggttcagatttctttccattgatcctttgtctttttactctataatatatttgatcttacaggagactatgattttgatgttagctactttgcacattttctttgtggcctttgcttttgtgtcttttataggaaggtcttttgcttttgatcattggtatatccaatcaaatattttctgacaatttgacagttttggtttttcatgtttaagtctttaattgcaatttatatttgtataatggattttggaatgaatctaagtttaacttggttggatgttatattttgcagatggctagccttgttctaacatcatttactaactagtccatttcttctccactcattaaaatatcaactttatcttttaaagttttatatacatgatgattcacttttagacttttttctgttccattttttacaatttatagatgcctacaccaatattgcaatactttacaatgtacagctatttaattgctgtaaaagacgtcttcttctatttttctctaagcagatttaagattgctgactatattttacatcgttttccttgtatactgtgataccacatccttctttttatcctcatatgttgccacttctcgattttttaataggcttctcctcctttcaatactggtattcccttcaattttcccccagaccctcttctctcctcactctaagcacacttcatgagctaatgtagcttaatttcaccaatatgatgctactcaaaactgttcttctagcccaagtttcttttgttttgttttgctaagtttcatagccacatatccatcttcactttgatgttaggttcaaaagtgaacttatcatctgccatgcctgatatagtttagatatttgttccctccacatcgcatgttgaaatttaatccccaatgttagaggtggggcctagtgggaggtgtttggatcatggcagcagatctcatgaatagttttgtgacgtctttgcagtaataagttcttacactactcgttcttgcaagaactgattgttaaaaagagactgtcagccatgatggcggcacatgcctgcagtctcatctacttggaaagccaaggcaaaaggattgtttgagcccaggatgcaatgagctatgatcacaccactgcactccagcctgggcagcagagtgaggccctgtctaaaaaaaaggaaataaaagaaaatggttttggccaggaacagtggctcacacctgtaattccagcacttcaggagaccaaggcagcaggattgcttgaggccaggagttcaagaccagcctgggcaacatagcaagaccctctctctctaaaaaaaaatatttttttaataagagaatatagacagttgaattgcaaaggaaagaaaatgactaaaaatggtcatttctatgagtgacagatcatgggctatttaagaagaagatttaggatgaaagtgaaaataaaaaagttactccttttagattataactaataaattacagaaagtggggtcatttcaaatgctgtgcttcaaagaatactttgaagtatttattaaataatagtacctctgcagatgagtgagtgttttaaacctagtagtcttagattaatattactgtgtttggtggagataattagatagatactgggaaagacatagacatagacatggacatggacatgcatatcgatacaggtgtaggtatatccttaaagttttctcaagctgcaaatggtgaagtatttgtatcatgggagaacacagtcagcagttgcctctaggaaacagggacactggacactgaatttgttaagacacttcctatgatgagcaacagaaagccaacttaacctcagacaaaaaagaaaatccattgactatcataactgactgtcttagtctgcttgggctgtcataacaaaataccacagactgagtgtcttaaacaacagagatttattttctcacagttctggagaatggaagtccaagaataagatggcagcagggaggtatctggtgagggctcttctcctggtttgcagacagccaccttctgtctgtgtcctcacatggtggaaggagagagacctcttgtgtctcttcctcctcttatgagggcatcagccccatcagattaggaactcacccttttgacctcgtttaagtcagttgtctccttataaacctatctccaaatacattggaggtaaggacttcaacatatgacttagggaggaggcataatttaatccatagcaccaactgtttgaacttgatttctgagagaccattatcttggctgtgcatctgccttcagggcactccttcttgatcttctttgctggatccttctcaatttcccattacctaaacagagtttagccttgggtctattctcatttcctaagtgatctcatgccctcccacagctttcaatactatttcatcgtccttggtgctccagaatgctatataagctgcctacataagattcatatttggatgtatcataaatattgcaaaggtaacatgctatctagcatcacgttagttaatgacaaccaaactcaaataggccctagtactcttggccatcatattatatttctctggtaatttaggctctttactctggtggatgacattttatacctcctttcctcaaacctccatcacctccccgtcccctctcttagacaattgtcatttcactgagaaattagaagtcacagagaatgttcacatacagtgacggttgcactgccattgcaacctgcctaccaacacctgtaccatttactctgttttgccttctatgtctatggatgaaacatccacactcttttccaaagccaataactctgctagttatatatcactgctgaaacaaactaacacaaaatatattagtccctgtttctctaggtgggtttggctaggtactttgcttaaaatctcacaaggcaagaaaacaaggtgtcagcagggctgtattattttctggaggttccagggaagactctgtttccaagttcattcaagttgttggcaaatccagttccttgcagttgtaggacttaggtggctattttcttgctagctgttagttgggggttcactctttgctagtagagatctcttttgcatccttgcacacgggctcacaactcagagacagcagcatcgtgtgaattcttctcaaacttggaacttctatgatgtctgctgcatctctcttctgcttccagccagaaaaatctctctgcttttaagggttcatgtgattagattgggcacactcagaaaacccaggataaaatctccctactttaagattcataacctcaattaaatctgcaaagtcccttttgccatgcaattaacatgtccccacgttccaggaattagagtgtggacttacctggagggcatgtagcctaccacaaatttgatttgtgccccagaaatttgctccctctcttccgcatcaccaattattccccttaactgcattttttccatcagtgtacaacatgctgatattccttttcaatgactgctccatttctctgctctctttggggcaaaacaccttgaaataattgcctatactctttgttcccaattcttctttcgtttttcttaacctttcaactttctactacactcaaccttcttttgttaaagacacaaatgattacacattctaagtttaagggtcaattttcaatcttcatttaagtgtcattttacacagctgatcattgaaatagttaatttaccttctaaggcaccattctctcttggtttttcttatactttctggaggctccttgtcagccttccttgctagtccttctttatattcttgacagcataatcgtggactgcctgcagctcttccatctgcattcattcccttggtaattgtatctagtttcatggctttaagttctacaggtatacaatgacttccaaatttatatctacagcccagaactgtaccctaaactgcatgcttatatattccactgcctagtcaacatctccatgtagatatcttacaggcaaggttaacaaattcaatatcaaacttcatcttccccacaaaacctgcttctcccgccatcccttggtcagtgctagctctgttcttctacttgatggaaccccaaattttggagatgtcattggctcctctcactaatctccctcctttgtacttagcacccaatccatttaacaagtcttattgtccttaacaccaacatataattggaagtaaaccacttctagccacctccaccaaagcatcgtggtagacaccactaggatgtctggcttgtttattgcaatatatcgtttattagactctcttctaccttgacctccacatggtagccagagcgatcctgtcaaaaagtaagtcagattgcctcattcctctccttaaagccctgtttcatgcagacaggaagccaaagtccttacaatgacctagaaaactctccttgatctgtcacctctgcacccattgccatatcctactacttaccagccaaatactccagtccccagagccttgcacttaatgtcctcttgtttaaaatgctctccctatgcctccctcatcaacttcccctttgtgtccaacatcatctttgcagtggcaccttctctgcatactcactttaaaattgcaagcctctatctgactagtgacccttccctctcctgtttcttcttcacaacagtattaccacccgatatcctatataaattttttatttgttgttatggccattctcctttcagaagaatctaagtttcgtggggtcaaagaattacgtgttggagggtgtgtatgtgtgttatatgttttcactgcattctccccagcacctagaacagtgcctggtacagagtacacaatcaaatatctgttgctgttcagtgaaggtccagaactgttatttatttcacctcaaaaccaggctcttctcccagtcttccccatgtcagtaaatggcaactctagtccagtttgcccaagccaggaacctggaaattactcttgattcctctctttttctcacacctctcatcttcaaatactgccaacgctctctgcaaatacacaggcccccttccaaaatctggccctcccaccttctccactgctctcacccaagtccgagccatgatgtgctctcacttaggttagcacagtggcctcatttattggtctctctgcttctactcttgctccctaggagtctatcttccacagagaaaagagagaaatctcttcagaattcgtgtcgaatcatagacattcctcagttcaaaacactctgataggtaggttttcaccttggaataaaatctaagtcgtgtgcatggcctgtaagacatgtcctgatcttgtcccagacataccttctgaaacttatttcttccctttgctcattctcttccagccactctatttcccttcctgttccttggctctgccaagcactcatgtgttgtgggacctttccatggcttcatctgcatggaaggtagaggcacacagtacctgctatgtcccatcattcgggcctccgctccaagttgctttatcagagggctgccctgatcatctttcctaaaatagcacacacaccacacacacacacatgcacgtgtacacacacacctcattctccttaccttattttgaagccctcattgccaactgacattatacgtttacttatttttctttgacaatttccctgcttctccaaaatgtagactccatgggggcaaagaaccatctgttttgttcactattgtagcttcaacaccaaagataaaccccaacaactacagggatgcttaatcctagcgcctaggctcttagggatacataaatactttctttctcaaagaaacaatattagtatttgaaaaaggaatgtggacattctttagtgttgcgcccacccctaaaacatagtctgcctcggagcaatggagaaatctgattggcccctgtgggtcccatgcccccttgtggctctgtcgtgggaatggggctgggggcaaagtccatgcaatccatagaagatagaggaaggaaagttccgcccaccgcccacccaaaaaaggtctgttagcagaatttaggatggggatggggaaaaggaggaggatgtgggggaggcagaaacaacagatggcaactatggggatttttccagagtgggaagtgtaacccagggataagctggggtccctggtaaaggaagtatccctaaataactggaccttcatactctttgggaaagaacaagctgaggccccaggcacacctgcatggcatcaccatagccttgcttcttgaatgactcctgctggcatcaggaggcatctccctggcaggaacaagcctgaggcttcaccacggaagctggaggaaacgcagggacccatggcacaaactgacacaggagttctatgtttcattgcacatcattttgttcaccagtgcatttgtacgattctgcctctatggctatcaagtttaattaacaactcatttttaggtaagagtaaaaatgaattaggtaaaaaaaaataagcaacagctgccaagtgagcatggagcacatacactcacagatggaaaaaatctacatcttgctgctatgatttagctcagggttttatatttaatttttgttttgttttgcttttgtttttatacacctcaccacaaggtattttaaattctttaaatgtattcccgaatatagaaaatgtttcttgggctctcctgagagtggggtgcccaggctgaccacaggcacacacacattcttcccatagtacagtactttaaaattaatagcacatgcagaggaaaaactaaaccctttgacgtcactcttgaaatgaggaaacataaacagaaaaggctccactccagtaagctgccagagttgaagccgattggtctctgcttttccttgcctgtggcaactgacagcacctcccagcctagcaggccggcggctgctcacccagccagtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttctttttttttttttgttacttaattatattcctaatcctggatgaagttgctggattctgcagcacaagtcttcatgaacaagcagcaccgctcagagatttcacggcattcaaaggtcacagaactgccactatggttaaatgtcttgtttaatggttgaggtatgtacaacaaatttaagcggcaagctcagttttcttgagagaatagagtcacagagagatggcaggatttttatttaaaatgaacctgtacatatatatgttttttgtctgtgattgttactacagcaaccagcttttgaatttccttcctttttctaggcgaactgactaaacattatcacttaccctgaattaaccgtttaagggcagcagggtttcattccaaccagtgtaatgagactccggcattttcactgcactttgagcccacactgaggtggtctttaaaaaaaaaaataaagaatgcaatattttttttctccaacataaatcttggagttgggtaattttcatttttggtgggacaggataggaaaatgctggtaaagggattggtaaggtttgtggaacagggaagaaggaaattagtttttttcttgagtttttcatgttggttgatagcagacttcaagatgaagaaattagtggcaagaagggaagaagctgatagtgagactgaaggtagaaaaaaatcaatagaagatgtccaaaaaatgagctctgaagaaaaatccttcatcaccttgttgcatttttcaaaaaatgttttggattcagaagtccaggagagatgcaagtactaagttacatgaccagaaatttagatattattatttataaaggaaagtaaaacttctttattaccactgcaaatttgctaattatcttttcctacaatagttgaaaatggagtcagatattcaattaggggcttaagtgattgagcctggggactaattaatcatttaaaaattctgttcttcatgtgctctagccagagtgactattgcaataagagtaaacctctttgcaccagagacaggcataggcattcatatacagtaaacacactaaatgctgcaggaagattggcaattcaatacagggctaatgttgttttcagtggcacattattatgtcttaaggaggatccctgctaaaaatcattcctatccaaagagtcggtttttgtaacagcaatttaagtaatatatggttaccatggatttccctattacccttctcaaagttatgcaatagcaaataagacaggattatttgaaatccttaccctgttccaaaatttctaaccgattttcttaaagtttctattctcaacattgagaacctgaaagctttaaaactgggtcatgttagcagtaatattaagcacgatttcaaacatgaggtgtatttcaaagggttaaaaaaattaactgcataagactggaatgtactaagttaagaactgcaaaaatattagctctgaaatgcagaggatgtgccgtgaatggacaattgcttttctgcagcgcctagtgggaaaacaaggactttgtgtgttgcaaacgcataactgcagctcctccatttcctctgctttatcttttattactggctggtgaaacaaagacaggtgtcagtagttacgtcttgattgacattttctccaataaaatgaagtcacttttgtctcaagtagaagcccacagttaactagttgcaactccaaaaactgtctctgccttgtaagaatttttacctgacactgtaagctgtctaatttcagaatgtactcactctcttgaacaacatgtgacaaaatcagtggtgactatatgtcagcaaattagctgggagaatttttttttttaattaagttatttagggcaagggtggaaaagtctaagatgtgtcagggacaggcattaatttagggaaaataattacacgagtgcatcatttaatgccttacacagggttcagcacaaagctactcactgtcagttctccataaaaacctagttaaaatgtttgcctagaatttactacctttcatatattgtaaattatttaaataattttggtcttttcatgtgtttttgaaaagcacttttggtgtcagtccagcctgaaatattatctaaaaatcaagtcaatgatacagagaaggacatttcaaacactgacactttattttcagcctaaggacatcttaaatgcaaaagtaaaatgaccaagtttcctcaaagtgggaatgtaccacctggaaaatgcctcagcctagtaattattcgtctgaagtctaacttgttgttagccaggcccaaatcacaggaggaagctgtttgttgactcacagaagatagtgttggaaggaatttattaagtggtaagctaatcccaaagaatactaaaagggctttgtttatattaaagagaagtgtcaaatttaaggatcagaacagactttgaaacatctaaatgtagaagctaagaggtagtctaagtagttgacctcacattgttggggtacataattgattggaaactctctatctacagaaattcttatctgaataatccactatcttatggattcagctctgtatcccctcaaaaatctacagcttagtaggtatctatgttctagggggtacatttgactgaggaagaaaggacttggcatttggaaatgtgaggtctctctcacagcacaaagaccatctctaatctctattgacacctcctcatggcggcagccccatttcccctaagaatgtactttggggagcacttccactgtccacaggagagtagctgtgggatcagcaccactggcttctaaagacatcctcagtggctctaggaatcccctctttgattcatgagatggtgcctactttatatattagcagtctttaatgtggtttacatgcaaacttgaagaagagaaggagaaaagggatgtagaaacccaaatcaactgaatacctattatgtaccaggcattgttagaaatttcagtacagagagtgaaatatgtcaaagttcttatgtgtggtcaaggcatttatactttctactttctcaagaatcatttaagtatctaaatgagttgatgtgtacttagagagtgatttcatgaagtgcactagaaagggcggtgaacagaggtagtgaaccaaggtggttcattcaggctctaatgagctgggtgactctgagccactcactcattcttgacctcagtttcctcaattgtaagagcaactggttgcgctgggttatctctaacatccattttagatcaaaatttttatagtattcttattctcaacctagaattttttaactccatttacatgtaaatgtagaagtgtcaaacctttattccaaaaatcattactacatgttttcaggatgtcaagggctgtgcctgtgaataagcaatgattcccacattaggaaacgtattctggttgagtatgaatatttaaacaaatgactggagtctgtacaaagaaatgaaaaaacaaaaggagaagtctgagaaggaggcagtgatggaaaactgcagaggaggcagctctatgcaatttggaatttaagaaaaaaataaattgtatttctatttaggtatttatttttatatgatgatctataatgtgattaattaagtgcattgttattattttggaaatcatgtatttgcaatggtgttctcaaaaattagaatgttaaagagagccaaaattttcccataggttgattcagctgctgtacaggcctgatttggtaaatcaaatccgtacattggcgtcctcttcatcattccttgaacttaaaactgtaggagttatggaaagctggagtctttagagagcactatgggcagccaaggtcccagcaggcatctgatacaagccaacaaggttcatagctgtgatggtcttgaacactggcgcaaggtggtgtcaacatggtaggaaattacctcagtgtcaggaaaactctcatggtggctcggaacttcaagattacttgtgggagtgaagacacatttcttcaactctggagcttccatttcttcatctttaaggctgttggatgccctttttctttccaaattctgtgatttaacctgacaaaattaacactgaatcattagcatgtgtttacttttacttttccacctctcccattccttatttccactactctctgtgtagtttgcctttactcagttgtccacatttacacaattttacctccaagataatctcattgccaaggaaaagcaaaacaaaacaaggacttgggtttgagaattcctccccagaaagactatcactcccctgagacagtcacctctcctcgctccatttctcttgtatcaggttgatgtgcccctctgtggctgtgacactcctagagaaagcaaagaggcatgctttgtgaaaattgtagctagaaactttaatattacaagacaaacgtctttttcctaaatgccaatcactgtcctggattttctatattacttcacttaatatcttctcaatattaattctgatttctttagagaataaatgaaaacctgttgataactaagttgagggaaccttcagaagaaagttttggtgaattgattgtccattgagtatctgctctgagaccttgccctgctggtacagggttgctgccccttactagtgatgggatttgatgcagttcaatcaccttaatcgagacatttctgggattctgcgtggctcagagcattccagctggtgtctgctctgagtgagagtttacatttaacacctcaagcatggaaaatagggagctggttttgtagttttggataaacctaaaaacaacgtaacagaaaacacacagacatctattaagcaatatataattcttgatactactgtataaatatcccaacattttaaaagcttaaatcctttcatgaatggtttacatatttatgtgtatacagtatagaagtatgaaaataatagccacagtcaatataccagtaaagaaactttgtcatgcatttgaagttccttcctttctgcccttcctccctcctctcttcctttcttccctccttcccttccttctttccttctgccctcttactccttttcctccctccctccctccctccctccctcccttccttcctcccttccttccttccttttcattctccctcctttcctctctctctttctctttctttcttgaatctgttaaggaaagaagggaaaaatagattggtaatgaggttttgaggagttttccttgtgtaaagtttggagtaatacttacttttttttcctagtggttggtgaattcatatagtttttcattaaatttcctgctgatatttttttcttattaataccttctgtgttctacatagtcataattcacatataaataggaagtatataaaatattctttctacaagatgaaaattattcccattgctttagaagtgctcaaaaaaggattctgttcaaaaatgaagtttatacatgacttaaatatacttaatctctaagaatcttcttttgttctggcgtgggggtggggtccaggactagtatggtgtgaggagtatgtttccataggtccaggcatagacatggagaggctaccatatgcctggattggtcaaaatttgatacctgaaggtaccaaacggtcagtgttttacattctctttgactctagcaaatctttgtctaagaacatatagaattgtttatttttgcattgtttgtaacctaaacaatatcagaaacaacttgagcccaataataggtgaattattgaaaaattattgcaaaatcatacaatagaacaccatacagtcatgtaaaagaatgaagtacctctacatgcaaaaatctggaataatttttcagatgtattaagtggaggggggaagctacattaacagtggtataaatacatagacacattcatatatactttttaaaaatttctggaaatttgaattaaaaacttaacaaacaatgccttggagaacttggagtatgggataggaacaaggcttacttttcttgtatatactttagaattgttcaactttcccctccataaatgcattatatttataaagggaaaaagttactgacatttatttattgtgtgatattttaaagtgaccagaaaaatttgaaggtaaaagaagaaagagttctattttattttatgtttttcattttatttaatttaattactatttttttgtttgtttttgagacagagtcctgctctgttgcccagggtggagtgaagtggcacgatcttgtctcactgcaacctccacctcccagagtcaagcgattctcctgcctcaccctcccaagtagctgagattacaggcatgcaccaccacacctggctaatttttgtatttttagtagagatgggatttcaccatgttggccaggctcgtctcaaactcctgacctcaagtgatccacccgccttggcctcccaaagtgctggtattgcaggtgtaagccaccacgtccagcctgagttctgttttgctttaaaatttcttcattaatttctttctttgacccttactaaatttctcccatgtacctttgacatggctagggagcagagaattccctggaagtaagaatcctggaagccaggagatagggagcccatcattcttatttgagtaactttgggccaatcagccctctgggcaccagctttctcatgtataaaatgaggggcttggtcaagctcaaagttcctttgatctgggtctaagaaactttggcctgttacacgcccaattatttgagatctttctccataaacaataaacatattttaccatacatattttactggtttgaacatcttgactaaattttgttttagaattgatcagttcagtttaatttttcacattaactatacatgcaaaattagtatttattcaaaccgtgtttaaggaaatcacatatcatagacttttaaaggaaaattatactataatatcagttattcataaaacagtagaaaacattatattaagatgtacagcttgtgcagttatgcaagcaagtaatgcttcttctgtttggatatgatttatacatttcttggttttccaggagagaaaaaaaaaaaaaagaccttcatttccctttctcattatgccacttgccagctgggtccagttagatgaaagaactcagtcattcacaaaagtgtagaaagcattcttgtaaaaggagatgctgcagtaatacagaggtctaaagaatgccttgatttagaaaaggtcattaaatctaagaaaaaagttattttctatgtgacagaaatatagtgtgtttccatgttcttaagatgagtgttcatgcttttccaattaaataaaaacctaatttcaattgggtttttagcttcattcggaaaagtgtaggtattgctcattttccatatttagtagtttttattttctgtttttctagatcttcattattgtgtttggagtaaaaaataatctttaagttaaaataatacaaaaggaataaacataaaacaggaatttgtgtgatagcagtttggaatgacaaagactaacattctaaacttttccctataaatctcttttaattattaaaaatcactaagtattagaaatatagttcaatggcttataaataaaataattgagaaatattgttctctttttcattgaatatgttgccccaagtgcccatgtgtgggtgcatgagagaggcccttcttaaacttgacaaaatgcatgtaagagctttgtatgtagtagtaatacaaaaaaaaaatcaaaacattgagttggagaatacagcctatttaaaatatattgtctcctttaatgtaagtctttagaaaccaaataatcaaatacatctattggattaaatggcaataatgagtaataatttaaaattcaatttgcttattttgtgtgaaaggagaaaaggaaaagcaggaaaaaaaaatgaggattccattttttttccaggagcattgaacttgtaacctaaagccccgagttcaagttccagatgctaagaatgatactgttggcaagttatttaacatttttagatttcaggtgtctaaaatgtaaatgtaaacctttaggttccaaaatttctggctttcctatgtaagtagttactcagttcataatacaaatgtcctgtaactttctagaacattcctgttagatcgggatttgttatgcccactttaaaggcaaggaaattgagactcagataaattgcggctaatagttgaaatgcaacttcagctttttgctgacagtttttaattgtttttatatgcttaaaatccatccttaatcattctaagaatgagttaggaaacatttttaaaatacacaaaatataaaaatgtctgttttgaaaatgttaatctacccactatatttttatacaaaagttcaaatatacagaaaaacagtattatttcattttaaatggatttaaattgattaaatggattaatctgatactttaaacttcagaaattttgctctgagaggcagtagagtgcattgatcaacagtgcataatttggcgacattcagtatggttcatttattagctctgtgaccatgaagaagttacttaatctctctaggcctcgctctgcttatttgttagattaaggtgtttctaatatctgcttcttgagagaattcttgagagaatggaatgactttttatttgtaaaatgcttagaacagagtatgaaagagtaaaacttaatgttagtgtatcaactggtattatttgctttcaagttttagaaattatttcatggaattattttgtttacaatgttgttggtgctttaaacatttaagataaatcttgttttaaatttttttttttactttctgaattaaactatagcacacataacagaaaattatctaacatataattatgcaccattgaacccctacatagaagtcaagagagtcaagaaatagaacattattacatgtttggcacctgaggaaacccatcatgcctcttccattctttcatgcagtgttatatctgaagactagataggttgttgcctatcattgtattttgttcattttcattgttgcatgatgtttaattatctgaatacacggtatttaccattctactgtagaaagcattttaattgtatccagtttttaacattatgaataatgctggcctgagtattcacaggcctgtcttttggtgcacatgtacaggtatatctgttgaggttatacctaggaataaagttgctgggccacagggaatgtttatatccaaatttagtaaaaaattcaaaattgctcaaagtggttaaaataatttacgcccccaccaacaatacatgttcagttactctacttcctcactggtaacttatcttggttttaattttcacttccctgtttactaatggtctgagcaccttttcacatgtatattggccatgtaaatatcttttttgtcaagtctctgatcaagttattttgtatatttataggatattatatatacttatatatatataataaacatatttgatacctttgattgttatatatattacaaacattttttccattggtaaaatctcatgttttattcttctcaagattgtttttatcatttttgattctttacattttcataataattttagaattaacttaagattcttccctaaaacaaaatactgttgggatatagatcaatttgggaagactggcatcttttctgagtcttccaattcataaacataatgtatccttctatttatttaggtgtttgttaatttctgtcagtaatatcttctggctagcttttggtcattttacatattccttgctagacatattactgggcacttagtattttgatggtattccaactggcatctcttcaatttctatttttaactttttgttactgatacatagaaaaacaatcaacttctgtatatcaattaattatcagcaaccttgcaaaactcacaaattccaatacattatctatggattattttgcttttccatagaggtaatcagagcatccagaatactggtggtcaccgattttcctttttaatgctgataactttgttttattgtactggataggattttcagtatattgttgaaggggtaatcgtggcaatattatcttgtttccagtctcagaaagaaagctttcaacattctaccactaagtttgatattttctataacatttgaaagtttccttttattcctagtttgctaagcatttcttattaaatgttctttaaaatacttttcgtatgacttttcccttttattctgtttataggtgattgattttataatttcaaaactgaaatcctaggataaatgtaacttggtcatgttatgttatgctcattttcaatatcactcattactctgtttctgaattgctaataatttttaggattttgaaactatgttgatgaaaaccattaacctaaaattatccttttttgttatggccttatcaaggttccattgactttattaaattagttaggaaatattaccctagtaaaaatgttctgggacagttttgtaagtttatattattttttttcctcaaatatttgatagaaattgcacataagtccatctgggtctgaaatattttgtggacaagtttttagttacagttttaattccatttatttttatgggctattcagattttctattttcattgtcagttttagtaatttctcatggatttgttgttgttgttgattatttttcagtgtttcttctttttgaatatatacatttaaagaagcaaatttatttttcacagtttcagctgtctcccctaggttttaaaatttactgtttctattagcagttaattcaagacaatttcaattataatttgtttttcacctgtgaattatttagaagtatatttattaatttgcaaacaaattgggatgtcctagttctctttttgtctttgtttcctagtataattctactgtgcttacaagtcataccattaagatctttgaattttttgaaacttgaatgtataaccgaatatatagtcagcttttctaaacgtattacatgtgcttgaagtaaatgtattctgcaattgttaggtatagtgctctatagatgtcaattagaagatttattcatcatatcattgaaatcttttgtatctttattgattttctttgcttctattactgaaagaggtatatttaaaaacttcctcatgattgagaattattttcctttattttgccatcatttgcttatatattatattgaacaatgtaaaattgccatttttttagatcaaggttgaatatcagcaattttataaaatttaaactagtattttgatactgtgctgttatatgctgccttcacagtaggggcaatacttagttcttggggagccaaaacccttagacatcataatggtttgtgacctaaaaaggttcagcacataaacagatattcagtcaagttggcattaaaatttccttgactggggggagtgtgattagggaaagaaatatctataatggctccataagggaggaggatgataatggaaaaaaggttgagaattccttataaacaattttagaactgttgtaacttcctggcgaattgaaattttaccatagtaaaacatcccttccaatttttttttttttttttgccttcaattctccttgggctgatactaaaatctataaagctagctttccattgcttagtggttgcatgccttatcattttttattcttttagttttaaattgtctatatgtttatgttttaggtgtgtctgtttacaagcagcaaataagtaaattttcttttatcattcagtctgactatatttgccttttcagtgaatatttaatccttttataattaatggaagcagtgatatatttgggttcaaacatgctgacttactatgtacaatttatttattcttcttgttctatatttctttttctctcctcactttcctaattatgaattaagtatctttgtaattgcactgccccctttccgttagctttagcttgttacttttacattattttacattgttttactggtgactattgcggttacaggatgcatctatgacctaatacaagcataatgcatattagtacttttattcctttgtggcaaatttgagaacttcggaatgccttaactacttttgtatccctcctaaattatatgctattgttaggtatttaactttatataatgtaaatctttgaataattatatattattatggtttcttacaattacacatcttcttcattctttcctgcatctctaaggtcacatataggatttcctttagtgcagtgatgattttgtttagattttggttttgtatgaaatggctttattttacctttatttctgatgtgtacttttgctggtaataaaattatagattgtaatccccctcctccttactttaaaatattattgtattgtcttatcacttttattgtttctgttgataagtcagaaaatagtcttttaaaagcaatctgtccatttcctctgtttgtagccctattttcatgtttgattgcttgttttgccatgattacttaggtatggttttctctgcatttatcccaattagggcttgtatggtttcttaaatgtgtgtcgtgatattgtttaacaattttggaaaattttcattaattatctctttcaatattgcttctgccccattatctctagcctttctttttttattattattattatactttaagttctagggtacatgtgcacaatgtgcaggtttgttacgtatgtatacatgtgccatgttggtgtgccgcacccattaactcgtcatttacattaggtatatctcccaatgctatccctcccccctccccccaccccacaacaggccctggtgtgtgatgtccccctcctgcatccaagtgttctcattgttcaattcccacctgtgagtgagaacatgcaatgtttgtttttttgtccttgcagtagacgaacaatgatagactggattaagaaaatgtggcacatatacaccatggaatactatgcagccataaaaaatgatgagttcatgtcctttgtagggacatagatgaagctggaaaccatcattctctagctcttcttaatgggactccagttacatgtatgttcgagttttgaatgttcctactcccattacttaccttcaatctctttgttcttcattttgaagattttctttagaccaatatttttatttccctaagtctttcttcatctgtatctaatctgtcatttatcccataaaacaatttgttaagttatgatattcttcggtcttaaaatttttagggatttttggtcatttctagctttctgtcaaaattctcaatcttgcctctcatatccttaaacatattctgcaaatcattataaaacttttgttgcttttattttgatctcttgagtgtttatagctgttgtctgctgctgctgctggttgaatcaaagtggctggttttcatatacctggttatttttgatgaagcactaggcattgtgtgtgtgtgtgtgtgtgtgtgtgtgtgtgtgtatgtgtggagagagagagagagagacagagacagagaaattacttgaggcctagtgtgatgttatctgtctctagataggatctacatttgcttcagcagttatcagtggtaataacaatcttgtcttaatctgatttcacattgaattaatatatatgaggtgattgaaagtggttggcacttaataagaagtctgcagctattcatttttatctattattgttttcttcaaaagatagggaaagagagtaagggtagtgaggagtagtgaatagtgcatagtgaggaaaacacatatagtattaaaagactccaatatggactagaagtaaatattcaaaaatttttattactttgctgtattttatcttgtatttgaaacaaattgtatcttattttgttttcaatttagcagatttattttaatcattaactttaaaaaacaaaagtagaacacacattagaaaattccaactgttcagaagggcataaaatgaaaagtaaaaatcttcctcttcctctcaccaccaccattcacctcaatctctatctaaaattgtttagaattttttaatatattcataaaaatgcatgttttatttgtacccacatctacatgtactcacctacccttttgtacaattaagaaataaattttaaaatgagaagtatttatcaaaatcataaactaagtaaataataatatgttcaccttccatatttcattgtggccattataatattatgcgaacatttctttacaaaagcattacaatctcatcagagtaataacgttagtttgtaattgttacttgccagtagtactttaacaaagtatcattctgaggttgctaataggctagggagatcttaggtcaaagaactacttgttacagattctgcctttcatcagtagctcacattttccatcaaatatatttggcatactacactattgagctcctgatttatggctttcgtgcatagaagttagtgttttcttgtatagtcgctgatataaattagctaaaattagctcatagcaactttcttcattatctaaattgtttcacagtttacagttctgtacaagctaatgtctcagaatgaaaatgatagtgcatacgtgtcgtaaacacataaaagattatttccaggacactagccatgtcctgtggaaatagcaaataaattatttagatgattgcaaataatataaaccctagagtaagcttagctatgctacggtaaaattctggtctagttatgtaaaactaggtctttggtgttctgtatttatctgttgcctctggcggtttgtcagcttttcttgggtgcttgtgttttcctaatactttatgcaggtttttcctgtgtgggggatctttcgagcacaggtgaacttgaagttacagctaataaatgtaaaatatgctaagtccttagcctagagtccaatcattaataatttatgagcaatttgagcaatttacaagtaacttgaaagtatatgtgtgtagaagagaaatagtaaacagttttaaaactgtgtttgctataactttttcaataggacagattttctttataaaaagatacatatttctagtttttgtaatattatgcagtatttttgttccttttcaaaacagaaattagaaaattaaaatttttgagagagtcaatgttcaacaattttaataatatatgttactaaatgtatgctaaaacattaaattgaaaacatgttaatacatcgtaaggtttaaaaattttttttaacttttaaggtcaggggtacatgtgcaggatgtgcaggtttgttatgtagggaaacgtgtgtcatggggatttgctgtacagattatttcatcacccaagtattaagcctactacccattagttattttcctgatccctctccttcctcccaccctctaccgtccagtaggccccagtgtgcactgttcccctcttaaatggtaagttttatgaaacgttactcttctccgttgataatattataccttacaggtaacagtagaagctaaggaaaagtgacttaatatttaagccgaaggactaagtacattttaatgtgttactccatgaattttcttaactgagaaaatatttttaactttggcatatttttaagtaataacaaagagttatcacaaactggagctgcagaagtagataatagcactaagatacagtttttaattgctactttctgtgaaaaggtgtatgagttgttctctttaatacagcaaacatttacagtgtttcttctttaaagtaatgcaaaaaggtaatctaaggaatccacaaataaatttttcaaagctcattttatgtgttgaattaaaaaaaatttataagtctgataaatttgacatgcatttaggttattcatacaatcttgagtaagcaagatgacatttattttctaactatgaagtgaatcccaaattatgtcatttatctccaaagaggtctcacaacatagcttttttttttttctaattaaattttcaggctaggataagttctttggcactaccaagatgagtttcaaattctacatggcagagggttctctgagtttttgtccttgtcttgggccattgttccacaggtagatgccagcatggccatatcaatcattcacctctggtcgagctaatggttaaatatttttactatcaccatcacccccactccagtgcctgtgttttatcaggatgatggtggaaacatcaattggggagataaacttttttttttttttgagacggagtctcgctctgtcacccagtctggctggggtgcagtggcactatcttggctcactgcaacctccgcctcctgagttcaagtgattctcctgcctcagcctcctaagtagctgagactacaggcaggtgtcaccatgcacaggtaatttttgtatttttagtagagacaggattttgccctgttggccaggctggtcttgaacttctgatctcaggtgatctgcctgcctgggcctcccaaaagtactgagattacaggtgtgagccaccgcgcccagccttggggagtacttgtgtaatgaacacagttctgatggtgcctgtgcactattcattaaaaatgattcttactcctgcttaactgaaattgaattttaggcacaatattttacattgtcttgtttagtatgtccgaaccttaagtacactggctcaattgttttttgactatgacagtctcagataaatcatcacatgattctgtgtttcctactgctgaaggctgtgtacatatgtgtgtgtataaatatacatatattatatcaagccattgaaatgatcatcttttggccaaaaaagtaaatatcagcaatttcatatggcccaatcgtgtgtgtgtatgtatacttgtacacatatgagggcataaaaccagatgactggtatatgatgttagtcttttaattaatagaatctaaaattataagtagtttccttagattttaggattggggtggatagagactgctttcgatggtgtgaaagtatctgtaatttgcacatgtgacaaactattaatcagccccaaattttagtataaatatatacatatatttagtacatatactattactgcatagtatatttatgaagtcttgagaaaaattctgattcctgcttaaatctctcaaataatctcagaaaatctctaatatatggataaaattgtccccatcttgaagaacaaactcagactctcattacttaattagcataaagtcagtacttttaggtgagagagcctagatttattcattcaaccatcaggtatttggggccctagtatggtctagggactggaaataagtagaaaaaacaaagttcccatccccatgaagcttgcattccagtcagagatgactgacagttactacatagactagtagttgtgacagttaatttcagagattgctaaatctacgaagaaagtaagacaaagtaatgagacaacaggttgctggctgtggagacttggctccatagccagaagagagcccaatggagtcttttctctactgaaatgattgagaaagagacagccaaacctggaaaaagagtgatcccggcagaggagagagcaagagcgaagtcctgagaagaaaacatgttttgatgtctgaaagacagaaagggcagtgcttttggagcaaaatgaggtgatgggatggaaggagatgagcaggcatgggaaggtgaggcacagggcatgcagatattcacagggcgtggtggaaattgtactcttctcacagtaaatgagaagccactgaaaccatgtagacagggaggagagaccaagtgattcatgctttaaaaggagcactctgactccagtgtggagaatgggttgtcagcctaggctagggacgacatcataagcagctggtgggtgttgtaggcaagatgggagatgacgatggcccggagtaagctgaaacactagagtggtggacagtgttcagatttgggtatttactataggaatataggaccaaatggtggattggatgaaaagaagaggcagcaatacacaatgctgtgattccagattctggagctgggctccttggtggcatgttctggctctgccccctatcagctttgtaaccttggtcaaatagcctcttctcagtttctgcattggtaaaactggtggagggtgctaatagtgcctaccttagaggattgccataaggattaaatgtgtgtgtgtgtgtgtgcacacaggcttagaactgagttcagtagtaagtactacccctatttatttaggtgatatgtacttgtgaaatgtacatttcacaagtacatatcacctaaataaactaaatttgagaacaattgattatagatttttggcctacatcactaggtggtaccattcactgaattagggaagatcgagggaggatcagtttggaggaggggagatgcaggaaataagagttgtgtttaggacacattcagcttgagaggcctatcagtgaaacagagatgaaaagtctggaattcagaagagagatgaaaactgaatttaaatttatcaatatatatgctatttaaagccttggaactggatgagctcacctaggaagacaatgtaaagaggaagagggtggagaatgaagactcccagaagcgtggggaggttgggaaaggaggaggagcaggaaatgattcaaatgcatccacatctggttttcccatagtgctgcctatattattggagccctgcccgaagagctcatgctacagaagcttctgtagacatgaaagcctctttagacattcttactggtaaggggctgaggcttccagtttggaccctgatgacaggaattttccatttatacttgagagtagcacaaagaagctgtggtaggaatctgctgctctctatttactctgagatgtttttagtgcaatcacagttatatgtggcccctaatgatagatcaattgttttaaattgtgtcattattatatattttactttacatgaagagatgggcatcttcaatttacaaagttgattagaactgaaaaagaatgtttccatggacactgtactattcattatcatttgattcccagtcagcccacaaaagcctgtgtaacccacaaggacgtgaaatcaaagtacaaagaccacatagatcccaaacagcagaagcaacagggcttacagaaatatttgcttagattccttaagataccagaaagacattttcttctcctcttatttgggctcagcaaagcaaggacagagagttgcctattgggtggggtgggaggagctagggaaggcacttctgtggccagttactcacatgggtagtcaatgactgtagaaaacataaatgttgaattgagaaaaagaattctggggaaagacaggaaactggaaatctactcttagctttgacagctacctgtgctatggcctgaaggaagtcactaactgttccgtgcctcagttttctttcattttatattggctacaataatcactttcaatgttgtcgtaaggataggtgtatacacacacacacacacacacacacatataatatacacattcatgtgtgaccatgtggatggtggaaagatctaagtaactattaactattgtttattattattgtcttgtagcctcatatcatctcttggtttttaattttaattaatgattcttaggaaactatgaatggcaggactttaataatgtggagcaataataacagaaatgagatttaaaagaaaacaacaaattcaagcaatgcgggagaaattttattcataacattgtgattaggtcacctagtttctcattagctcttccaatttttcctaacagatgcctcagtgagttgtcaaaaatgatctaattccagcctttttaaaggcttggtgcttgcagcaaagagttcagttgctttagcaagttatcttatgtaaatatggccagtagcatcctggtaatttgcctccagaaagtaatctagaatttcattataaactcttatttattctcacagcatcattcagtgtactaagcagggagaattcctgtttaagattttcataattttatcaatgacttaccaacattgctcaggcttttcttgtagagtatcatccacaatacactaacattgcaattgtctttttaaaaatattttcaatttcacataagacactgcaaaaaaaatcatacagaaaagatatatttgagctttgcagtttgtatagcttctccaaagaatgcagtatgtcaaatgcaagtgttcacagtatattaaaaattggttaggaatcagtgtttcctttctatactgtcagattaatgctctttgcttcaagaccacacagaagaaaacccaacattgtggaccctccctacctaacaaagtctcacaaggtgaactcattctatgtttgaagtgagtctgttggataaagactatcaaggactatgtagacacattaactgaagtctattatggaaattttgtctgaaaatttacttttctgcccacttaatcaactttttgataagttaatatataataaaatgcattcagtatacatgtgaaccttggaaaacataaccttatttaatactactcatttatatagtagtgagtgtgtgtgaatgagtgaatgtgctttatttctcatttctccacatccaaatctttctcttatgttctgtttttgaaaacttcataatcagcagattaaaactatcttgaacttagggatgatttttctcagtttatacttcattctgtaaatagaaacgttctatgtaacgaataatttttgtatacatggacggtccatgtatacgattgctccatactatgaaggttcctgattttgaagctgggtgagtgagctgagagcgaaacaaatctagtgatctgtcattaagtggcaattgttgtttaactcccttcacttttctctaccacaagtttctaaatttctgctgtcaagaacacacctgaatttctaaaccattcacaaacacaaaatgacatgacagacacaaatatctatgaatgggggtaaagatgccttcccaatatcttcaagtgtctgctttgtctccaggttttgcaaactcaatatttgagtccacaaatatgcacaaaatttttttcactgaaataatacggtgtcttgtgagtagttttattttggagtttttggctaaattgtttttgaaggattattgaattatcttttatatagatctttaatatagtatgatgtagttctggtagttttatgaattctggaaaataatgggtgcttggagacaatagtagaatttactgaatatatgaggtaggcatatatgattgattttggagggcattgtttttatcttcattgtgattgcaatagcaacataaacatgttgtaagtagataggcaaataagaaaatgtaaatattgataatttttaacttataatcaatataaactttggtttatattcacagacatagacaatgtttttatattaaaaagtttaaaattttaattgcaaatatttcaaatataagaaaactatcagaaataatatgacagacatccatgtatccaccacacagatggccatctattcattaattcatttattcattcaacaaatatttattgggaactactaagctagatgttgttctaggcacctgcagattcagcagtaagcaaaatagatcataataaattcaatccatatgtaaaagatggtggttgctgatgattgctatagaaaaaagaagagcagagaaaatgctagggaatgtgggaggatgggcatgaaatttttaagaaggtgcttgggaggtctcactaagcagataacttctgagacttgaaggaattgagggagtaaaccatgcagatacctggggaaagaatgttcacagcagaggacacagcaagtgcaaatgcctggaggtgggaatgcatctgatgtcgtgagtctctctgttatctctctgtctgcttcattaatttctatccttggtctaatggttttctttcttctactgatttgtggcttactctgttgctgagttttcttcttactttctttctaatttatgccttgcaaactataaatttccctccaaatgcctttttagctgaacatcacaacctttgaaagagggtatattcactgtggtccatttctaaatattttataatgtctacaattttatttctactcagtaattatttgaagtggttactttagatttcttaagtgtgacaagtggaaaggagattgcggtcttttattattgatttccaaatttaatgcattgtattaagggaatgctgcttatgtaaaatgattcctagatatctttgaggtttgctttgtagcttgtcactaatttttattttaaaaaatccatgtagaaatgaacatattttctgtaattgttggaaacagtgattatatgtagtcatcagagcaaacttgttaactgtgttgtcaaaattgtccatttgcttacactgggaatagtctattcccttacttatttgccttctgggtcaatgactgtaataggtaaattaaaatttcctgctatgtttatagatttgtaaatttctccttgtaattctgtcaatttttgctttgtatactttgaagtttgcctggtagataaatgtaaattcagagggataatcttcctggtaattgttacttttatttctgctaagaagtctattccatttattaaaatattaataatattctaatattaaaagcttctattccagttctcttttggttacagttttcctgatagatcttttttatcctcttactttcaacatttctgtgagtgcatattcttggtgtgtctttttaaaacaatatataactgaatttagtttttaatgcaatcactttcttttaactgtcaagctaaatccatatatgtattaagaattatttatttattcacatctaactttgttttgctattcatcctttttttgttacttctttgcttttttctgctttcaactagatggattgaggttttaaatatattttctcttattggtttagagattagacatttcattttttgtggtttcagcagatacactcacatttttagcattttatactagaataaaaatataaataaatttatgtgtatttaatatccctatcataccctagaaaaatataagaaacttactgaaatcatcttaaatgagatcatgtccatccctagaactgttattgttatatatatctgagctctactttgttttgaaaccctgaactattatctttttaaatttttatagcaaatgcttatctaaatttcctcatgtgtttcccaatattgctcaacattccttcatgaattcatttttacttttcaggttcacattcaatcttgaagggtatgtaagtggtaaatattttcagtgtttagactaaaacgtatccttatttaacctttgttcttgaatgataatttaacaggatctagaattctctaggttttcgttattttttctgagcactttgaggacaatattcacttgccatttggtctctattgttgccaacaaaaattcttttgtgaggctaattggtgtgactttgtggtcatctgttatttctggttgcttttaaggttttctctctgtggtggttcaggtcttctgcaaaggacacaccaagacaaaattagaaacaagagatttggggaggaaagtggctgtgaaggacagagcagaacgggaaaggaatagatagagacagccttcagacctcagggcaggtgtgacccgataaaaggggagggagaagaaaggaatatggggtaggaaaaggctcaagtagcagtgcagccaggctcctggggacctgctaagtagaaatggctgtgagaagagtttggcattagcaggaaggcctcagctgtagtaccccaccatgcctagcacagaagtggagcagtctggggagagagtggcctccgcacacacctgtggatctgaggctgtcggctgtcagctaactgcacgcctggtagcagctcccctttaagaggagagctgagggccaccacacttgtctttcatgttctacagcttcactaaagtgtctagatttacttttatttttcctaccttataatcttgcatttcttctcctacatttcatatatttcatcataagctggtgaaatttcagccatgctttcttggaaaatggcatctcctaccttttctcactttcttgaacttatatagtcgatagatatgttcaatatcctcattccaggctgggcgtggtggctgaagcctgtaatcccagcactttgggaggctgaggcaggtgaatcacgaggtcaggagttcaagaccagcctggccaacatggtgagacccccgtctctactaaaaatacaaaaaattagctggtcatggtggtgggcacctgtaatcccacctactcaggaggctgaggcaggagaattgcttgaacctgggaggcggaggttgcagtgagctgagattgcgccactgcgctccagcctgggtgacagtgagagactctgtgtcaaaaaaaaaaaaaattcccatccatcattatttctaaaccaccctttcatatttgccatatatttatttcactatacttcattgtgaaaatgtccttagatttctcttccagttcagtattttattgaactgggtctaaaatacttttgcttcatatttgcgttttcatctttaattaccatatatctcatttctagaagatacatttgttctttaaaaaaaaatctaccgaattctatttcagtgtccattctttctctataattttgatcttttcctttatctccagtaatctgcaacctgcttgttttgtggattccttgacattgttccattaacttgtgttctgaaacttctgtctgctgactccttcttgatggatttcctttcttttttattttttatttttattatttacttctttttcatgtcatgttttgggattgcttccaaatagtttcccagaaattttgccattctagaaccagtttacacattcctttttttttttttttttcaccttagatatcctgtaccattcagatgtcagtttcagatttgggctttcaattttttatgtgggttgctatttgtttcctttttcccatcctgggatgacagaaagaaattggcttgtcacttccctggaatgatgaccttttatttctcctttccctgaggggcagcccagggtcatgctaatgcaaagctctaggttccagttccttcactttggcttctaattggacaataaaaccctaaccctataccagaggtctcagaagtcattaatatctttcttagatttggttcgctcagaagcagatcctgagactcaagggcattccatattctttgggaagtacacagacctccaggaaaacaaaacaaaacaaaaaaaaaaaaaaagggaggggcagggagacaaaggaaatcaatagactgtttttaagccagcaacgtcagtggatgattaaagtgggaaacgggaaagagtgtaaaacacgtgcttcagaattaagccacccagagggctgaaggagctcgtatatttatacaccctatctggggagtcattggttgagggttactagagcagaagcaggagatagtctttgacatctccaacgtgccacatgcaattagagcaggtttccagagttctggggaaaggaagccctaatttatagagaaggaaatcctggcagttccaagtcaaagggaataccctaaaaggcccaaggggtatggacagagaactttcatcatctgccgcaatatcctgttagttgccacgtttctctcatgaccataacactgaatttaagttacttctttgctatggttcttagaaattttattttctttgatatttgtttaataaatcatttacatttttattacatattttatcagtctttttttttaaaatagtgtgtttatagtgggaaagaggtctgcttacgtcagtgctcatgttgttagaaccaaactttcaaaatattttaatgtacactttaactttataaaataatactaaatatgccatcacaacttgccttaatattcaaaataactttgacaacttttccataaccataaatgtaggtccactttactttgtaaaatgtatttctccaaattaatatagatatttgtctacagatgtcgctattacaaagaatgcaataaacattattttacctattctttcatacgtatgcttgtatatctttggtataaattcctagtactagatggcagggatcaaaacttttagcacatttaaactttaactgatatttgtgaaatctgcctaaattgcttttagcattctttattctcacccacagcttgggagggtatcttcttttctatccttaccaaaaatctataaacatcagtcatttgattctttgatgatgtgatgagtcaatagtgatagatcacttaatttgttttatcttaattattagagaaggcaaaacattttatatattcctgacaattgatattcacatgtacgtatttttatgggcctgccccctttttttatttgatttgtaacagctttatattatgaacactagccctttgtcatatatcttgagtatattttttgaagtttatatttcattttttgaatttgtttattgtgactttttacccatgtaaaattttatgaaaccaatttcatccatttttgacttcatggtttctcatttttcaaatcacacatttaaaaagccttctataattattaattataaaaagattttatgcagttattggacgcctcccatgaattggatataccatggcatgaggggaaagggacagagatgaataagaagccttttattgcttcaaagagtatcatattaaatataaaatatttttttctctagaaggaatgaagtaaatagaccttttcccctctacaaacaaacaagggaacagataacaagtctctaaacttgtgtatcttttttaaaagaaaaactccaaccagtcaaaacatcaacaaatatagtaaataataatattcagaactgatcagcgagaaagccaggcctagaactcaaggtctgtttatatactgatactgtaagactggcaaaaacagtgccacttcattagccaaggcatactctgcaggacctacaaaaagtggttttttttttcttaagagtacttttaaaaatatttaaccaatactcgtctcagtagcatttgtagacaactgtaatgaccataatttgctaaatgttgatgcaagaaaaatactttttaaagacataatccctgtccttaaggaaatacagttggagaggcaaactatatatgaatgaaacagcctaagaatgatatgaagaccagacaaaacaatgtgggatagatcttgtgcttatggtcagagcttaggaaaagggtcctcagtgcccctgtggcaatcaacaagtattcatactaactccatgtagaacttcctcaagttgtaatcttatagattgtattgatgcttgctgatacaaagaactcttagacattgggaatgatataaatctaaataaaattatgtatgtacataattatgcaaaactataaatatctacccccaaattaaataaggacaacccccaagtcttgatgttttaaatgttaatgtagtagagcagaaaagtgagcaagccatgaaggcagatgctctggaaaaatcactcttgttttcatacgcatcgtaaaacatcaccccacaaaccacatcctgacattgctgacattcacccctcctatacatgctcagcctgagcctgtttggcttgagttgcctgacagtaaaacaggattcagagggaagatgaaagggagaaagcagtggactacagataatccactaaacagaaaatcaactcagggaagtctccgcttggggccatgtactttgggaacaggaatgttggtgtataacttgaggtctcatgagtttattcatccaacaaacacttatgaaataccgactacaagccaaacatcatatgtttagatgggtggagtcaagaggcactttttaagcagttagggaaggaaaatctcaggcaagggtacggtaagttgtatgtgtagaactaaggaaaacatcacagacatagtctgatggctgggaggaggcctcagattggcagtagaaaaactgaaagtaaaacaggattgaaagcaacgcttgaaagcaacaccatgaatataaagaagtaaatttgtcttcattcccctgtcctgggacttaagaaaaagagaatttggagctgatcttccactgggccctgaagttgagagaggcagaggaagttaaagccaagattgctatgcaaaagaaatctttcagcaaaggggatttcaaagtactgacctgaataatttccatttggggctgctgaagagaagcagttgtgttcacggggtgaagcaaggaggaaatgggaagttgtctggatgctttctttgcaatcaagataatactagagctcagtaagtgaggaaagaaaattataagtttgctaatagttctaatcccagagatgctgaagagaaaactctttttcttttctaggcaagagtcatctcagggtaaatctcagaccaggtatgaagttcgcacatttctctcagtcagtgtatttcagagcctgggaaatacagagaccccatggggagggtaggcaccatttgcttttattgcatttaagttttttggaacatgcaagtgccctatgctgttgtatgaggctacatgggagcatatctttgagactcagaaactgttggaatcacaatgatgtataaagaaacagtaaggggccaggcacggtggctcacagctgtaatcccatcactttgggaggctgaagtgggcggatcacaaggtcaagagatcgagaccatcctggccaacatggcaaaatcccgtctctactaaaaatacaaaaaaaaaaaaaaaaaatagctgggtgtggtggtgcatgcctgtagtcccagctactcaggaggctgaggcaggagaatcacttgaacctgggaggcagacgttgcaatgagctgagatcgtgccactgcactccagcctggtgacagagcaagactctgtctcaaaaaaaaagaaatagtaaggtcagtgttggagtctgcatgctaataggcaggtcccgcaatatattttttaataacaaacacctactgcaatgacctgttaatgtagagcagctgtaagcctgaagacttaagggaatagaagctaataaacccaggccaaagtgtactgtagataaggcaacttgtacagacatcagaattgaatccatttgaagtcactaacatctctctagattatttcctctctttctctacattacatgggattttattttagaagaactcaaaatactctagaagaaggcagttgaggttactgcattgtataactgaaataactgtacaattatatttgttacacattatttaaaaaaaaacagacttgaaaatgtgttggaaacaaacttgagaaatacctgtctacctcaacctcttccatcttcccacatgcgtgtttaatttgtagactgggttgaggtgtagtctttatttagtagaggtgaaattcttttgccatatttttcataatatgttttggcaccattcttcaatttagatttaaatttgcaagaagttattaggcttgggatgagaaggaaggctggcaggagcagctggcctgatttatctaagggaattactcaaagcctgttaggtataaaatttgtggtgaattttcctattggatatccacagcccaccaaattctcatttattaccatgtggtgtgacccccgctgagaacaaagacttcgattaaattattttctgtttccctgagttactgacagcgctaaaatatactatgaacctcatgtaaaaaaataaaaaagtcttcaactaagtaaaaattatttccaactttctctccctctgtgtttttcctgcttcctggctctcccctttgttgtttcccttcaatatcaaatcatattccacactgtttttctcagtttgaacattctcactttctccctttccattcatcaatctttctgccaccttccccttaagtatttcctcaatttaaaccttattcaataaatacatacacttcacagactgaacagatggattacaggactttttcccttgagatttccatgtatagcaattttcacttctcaaagaaaataaaggtgatgatgatagtgtctatgcagttttttaaagtaatttttgtgctgtgtgagctctgcaacttcagaaggcaggctccttaccacacttgacttgtaatttctattttgttaactatatctgttatgctgagaataacagattgtcttcccctatttgaacactttcaatgaccagtggagacctgaatatttcactagatggccggtagttttatggttcccattattataaagttttctattacaaagagctgaaatccatttctgtttttcaccattggtacaaaagagaacaaatataatctcttttttcataaggtagacattgaaacatcaaaacacaaatctcctctttttcagactacatatcctcaattactccaggcattcttcaggtatcagggtgtccaggtgccttgagttcatggtttctttttactaatacactccatttggtcaagttttctctttaaatcttgtcactgatcttgaggaatggcttagtcatacacaatttatgtccaccactaaagtactaatgtgtattctatatatggaaaatccccctaaagcctgttaaacatgcggctcaattggacatacactaggtgtcctaacagctctgtttaacaaggtgacactgagccctcatgagaaggccttcaagcctgcccagctcacatttgcttatgttttctgctgcttaaataataacaattcagcaaagttaagtgaggactgtctctcaatgtctaatatttattaacgagctatgttaattctcctaggccatcaagtcctaggaaaagaaagtaaatttctatgaaaagtaatttctaagtgtgtctgcaaaatccgatgatgtttattgcttaaaatatgagtctgcaatagacggtgctttagtcaacaagacaattacagtaaataaatgttgtcaatgagatcaacaagaaacctgctttattcaaagaactttcatcaagtgctcacatgtggctggcactgaactaggctgtgtcctctgtctttggtctacactctttgggctttcaatttgggtcaaaataaagagagacctcatatttccaggtcactgaatgtcctgcactgacatctaaagcatttgtttcagggcctcccttaccatgccgaagctctttcctgctggggtgcctcactctgatgtactcagatcaccagtgaaaggagctggcttctattaattatcaggttctgcccagccttgctgggttaaatggacatgactaaatttgcatggttgatttccccatcggcaaagtcatctgggtttcagctttgttttgcgtttggtaggaaggactcatttaatacactgaatatgactatattttataaatgtttcatgtaaaataatctctgaagcttagtatgtataaataaattcctgccatttgaattatagcagctcatatcccacacatctgcagagtttgcttgccagtactgtccatgtgggataaataaatatcgctatatatttaatgggtctatgttagcttcatattttgcttaaataatgggtgaaattaaatattccaaattcatttttttaaaagtagattctactagtaaccacttagtgtgtattgacttgtcagaattttcagaatttaaagcatgctccagtggcgcaatcagctagtgtgcagtacttggtatcacaatgtgcaaggtatgtaggttctttcttctagtcatcacatatgatcattacaattctattttgtgctcttttcaaccagtctttccggcagaattttcagaattttcctgattcgatatcacagaagtcctttctatggctttttgacttcatgtccttgaaatctctatcctggtcccagtactttcttaaggtcactagcatcctgtacaccaaatcccataacacttgctggtcttattctctattgactatggcatttaatagcattgacagtcagtagtatttatagaactctcttctcttgttcttggggacacctatatttctaattttattgattagtcaatagatatttattgaacactgggattgtatcatgtgtatctttcttcttgtctccttccactgctcttttcgtgatccctgaactcaaatccagtctttgtctttcactgtttttctcgaagctgtctgcctatgagtcaaattagtaaaattacaggaattttgagttagaagggactatagtgaccagttaacttagttagcattctacagatgaggatattacacccattaaattaaacgtctgctctaagatctcacagcatgtcagcggcagagcccacatcaactcatggaaaagccagggggatttccatgccgtcacttaacttgtgtagaacctgattcagggtcttctgaagccctgatccaaccctccactctcctggttttctagttctgccatcatatttctattcttctctatttcagagtctagattttagtaatatttgatatctctcaatttctcacttccccctactcttagagccaaatattcatgatgtttcataaagcctgttatcatgatgcctcataaagcctgtcatcatgatgccttgaaaatgtggggagggttttgttgtttgtttgtttgttttttgttgttgcttgtttgttgtttttttttttttttatctcactgccactaccgtggcccagggctgcatctgcataatggtgtgcacctttccagtgatctctcgggcatcatcagtccattctacactcaaatgtttgaaataccactcttcccacatcaacatgtcagaaaaccagtgctgatctccatttataaacagttctctttaaatctttgtaaatgttcagaaaaataagagagtcctttggagaagcaatgtctattgcaaatgaaaaatacacacattctgctattaagtgtaaccccattccaagaaattaagctttgaagaagaggaaaacaaacaaacaagcaaaagtaaagaggttactgaaagaaaagaactagctagctgctggaaagactggttgaaaagagcacaaaatagaattgtaatgatcatatgtgatgactagaagaaagaacctacataccttgcacattgtgatagcaagcaatgctgagaaaacatgtgagatggaaaagcaaagctgagtccaatcagttgtttctcataactgttaagacaagatgctctggcggactcctgttaattcacaggcatgcaggcacattttgatcatgtgtaaaaacttagtctataatagaggatccttactgctgtggagatttctgtcagctttgagcaaaacgtacaacttgactcaatttagtttgctgctagtttcttgcctaacctaatatcaacccccgtcacattttctgaaacatacaatggccttgcttcaatcaggacagtaaacagcagtagtcaaatggcagctgactgaagagtgaaaaatactaagataccgttgagtgcttttaaggacaccataaggtgtccttatattgtagttgtaatgaaacttttcctgagtgtagggttgtgaatcaatagcacctttatcatgcaggtgtgcaagaagccaaggacctctgcaggatgataacaacatgttacagcaatatttccttccctttatcatctttttcctaccttttttcccttaaggaatatttgcaaatttttttatttcagtagttttttgggtataagtggtttttggttacatggataagttctttagtagtgatttctaagattttagtgcacctgtcacctgagcagcatacactgtactcaatatatagtcttttatccctcactcccctctcaacctaccctgagtccccaaagttcaaacatcacacttatgtctttgtgtcctcatagcttagctcgcacttataagtgagattatatgatatttgcttttccattcctgagctacttcacttagaatagtggcctccagttccatccaagttgctgcagaagacattatttcatcctttatggcctagtagtattccatagtgtatatatactacattttctttatccactcattggttgatgggtacttaggttggttccatatgtttgcaattgcaaattgtgctgctgtaaacatgctcgtgcatgtgtcttttttgtataatgacttcttttcctttgggtagatacccagtagtgggatcgttggattgaatggtagttctactttgagttctttaaggatcctccctattgttttccatagtggttgtactaatttacattcccaccagcagtataaaagtgttcccttttcaccacatcacaccaacatctgttgttttttgtctttttaataatagtcttcttgcaggagtaaggtggtatctcattgtggttttcatttgcatttccctgatgatcagtgatgatgagcattttttcatatgtttgttggctgttcgtaaatctgttgagaaatgcctattcatgtcctttgcccactttttgatgggattatttgtttttcttcttgctgatttgtttgagttcctgtggcttctggatactagtcctttgttgaatccatagttaatatttgcaaagatttgctgagcatttatactgtgcaagaccttttgttagaggctggagatataacaatgagtcttgctttcagtactttataattgctctgcagattaactgtacagacttaaaataattttccctaacctgtaaccctaccagaaaaataattaagagaatatgaaaggatctgcttaaatcagaaaagtgaacgtatcagttagactaagtaatgatggtgaacccaatattgacaaagatactaaatatacacttaagtttgatatttatttaaatgttgtgtactgtattctgctttcaaaattattaagcaaagatttgtccttagtagttacccagtatttacagagaatatattaattaggggctttattttattgaaaaggcttaattggctatgcaaatctacaccctctcaattatctacatttggagcaagtttacttagttggtctaaataagcataatttgtggcagttaccttggtgttgtcaaatctaaacctttaaacaaaaaataaatctcatgtgaccttttctgaatgaattctcattgtttctagcagccacctcaatctttcagcccaatgtttagattcccctgtaatccaatcatgatttaccttttgacagtttactccctactactccccaattctttgttctactgcgcttactatttccctggacatatatttgtgattatttacatcatctttcatcttgctatgtcatctcttaattctctccaactatagtactattggcatttaacaaattcttactacctgtgaactactgcattgagtgcttttgcctatattatcccacgtaattgctatgatacctctatgacctcagtgagtttcgttttaaagacttttataaactgaggcttacagacactgagtaacctctttacaagaagaggactacttagtaaaaaagaggactaagtaacctgctcaaggtcacacaattagtgtgaccttcagttagttattgaacccagatctaacggcaaatctaggtacctaaccattatgttctgctgcttccaaggacttagagctatgctactggataattatctttgggacctcagataaagtaactgacatttctgagctccaataaagctgaaatacacacgtgtgtgtgtgtgtgcatgtataacaccttaaataggtgtgcatgtataacaccttagaataggttcttgttattttatttatacttattataggtataaaatataggtataaaataaacatcactgttctggactatttagaaatatagatccaagaagaacaactaatgtcgacagtaggtgtactagtttaaaaaataaatattataaaaaataagtagtataaaaaataaatattataggtataaaataaacatcactgttctggactatttagaaatatagatccaagaagaacaactaatgtcaacagtaggtgtagtagttttggttttctgtgtttataaatattttttctaattatataattctggtgtccagaagataaatgtgattaatataatctaccacaagcacatgcccttaaggaaaacaagcagaaataaaacaataagaaatactataaatacatctaaagttgtgtgatttctataagttacaagtgaattttactaaatatctagtctagatgattttcccagtgattcatccctaacttcagttttgagcagaaattcagttctaaagtttgcctaataatataaatggaatcttttactcagcaggttgatcttccaggggtcatgcccagttaatagattcttgaggacatctttaaattctcttaaattctaaaggaatcctgaggtttgaatacaatgacccaccaacagataccccaggcctatgttagagtataggtctaatgtgactcaggctctcactgaaccaccttcaacctgacctgggaagaccctggctctctagatccaccatgtccagctgtctccagctgaacaatttttttttttttgacagagtcttactccgtcacccaggcttctgacctcaagtgatccgcctgccttggcctcccaaagtgctgggattacaggtgtgagccaccgcacccgaatggtgctaccaattttttttttttttttttttttgagatggagtctcactctgtcatccaggagtgcaatgacgcaatctcggctcactgtaacctccacctcctgggttcaagtgattctcctgcctcagcctcctgagtagttgggattacaggcgcccaccaccaggcccagctaatttttgtatttttagtagagacggggttttgccttgttggtcaggctggtctcgaactcctgacctcaggttatccgcccacctcagcctcccaaagtgctgggattacaaacgtgagccaccgcacccagacggtgctaccatttttttttttttttttttttttgagatggagtctcactctgtcacccgggagtgcaaatgacgcgatctcagctcactgcaacctctgcctcctgggttcaagcgattctcctgcctcagactcctgagtagttgggattacaggcacccaccaccacgcccagctaatttttgtatttttagtagagacggggtttcaccatgttgatcaggctggtctcgaactcctgacctcaggttatccgcccacctcagcctcccaaagtactgggattacaggcatgagccaccacacccagatggtgctactttttatatcagtctcagtgtgtgaattgggcagggacatgagtgtaccaattgtttgatgtatataattattttctacttcgtatgatacatgattcacaataatttacaaactgataaaacaataacattttaaaaaatgaatttccattattagagatttctgaagaaacataatgttgggatatggtggacaagcgaagaatttccttacaaaattattctttactctctgattgttttaacaccgtaagtttatcagacaggttctagatatttcctatggtacttagagccacatgcagattgtttgtgcgttcaaactggtcaaagttgcggaccagagtgctgctattgatttgtttcactccggtgaatgtaaatcattcatgtttggcagcatttgtcctactggagataaaacataaggaatatgtgcacagcttcaaaggtgcagcttgactgtgatggtaacccagcacgcagtgggtatgactggcatttttgagaatacatcataaactctccaaggagtctgcaccatcttccctgagatcattatatatccaccaaaatgaggagaaggagaagaatgtggcaagagatcaaaagaggcagtcactataaactcacctattttgttgatgcaaggcaagttgcactaagtttaggaaagcaaaaagatactcttcgaggtccggggaggaaatgcagaaactgctaatgggaaaacgagcatggtccatataggactctgatattagagttgttttttttctaccgaggctgctctacccatgagtatccccatcttcaagaaactactaaaagttgaagtgtttattcacgtgttattttcgaacagttaactgtataaaagaaaggcatattttcttttcctgcatccataagccatgtgccaaaaaagctcttgtttaacatgcttcttaggattaaaagggtttctgctgcaaacaggtctgaattacatacgcatcttaaacatgcctcagctttaaagggacacattcttcaagtgaggctgcatttacaggcgcaatagatttttccctcggcataagccaaagagcagagacatactttaatatttctgacaagatctgaactataatattgttctgtttggaaaattaggcttcaaagcagaagccatacatttattttcaagatgagaacccaaagagtaacaaaaatgattagaaaaagaatctgaaagagtgagactcattaaaatgaaaatctttgtgttgatgactgcatataaaatcatagatcattagggctaaaggaagaatgtatttgccagatgttgaaatggcaagatagtttcatctctccctaccatctgttaagaattccatccacaggtctcattaataatccttgggaaaacaaggcaaccttcaggagcattgggaaaattatggatgcattataatgaagtcagagcaaaactgaggtgagaaattcaaacaccttctaaacgcggagctcctaaccagtggtccacgccagaatcatctgaacacagtgtttcaaaatgtgcattctcaggctccactgccagccattttcattcatttgggtgtggaatgaaacctaggcatatgaattttgaaaaagccttccaagtgattttgatgataattctggttaagaagagaaagcatgttctaccttgtcattatgtatctactacctttccagtagattgcaaactcttttgaaaggattctgtcatatttaccttgtgtcctctgctgtctgtagcatagctggactgtaagcttgaggaaggaagagagcatgctagttttgtttattatcataattactcctgcccacccctcccactccagtccacagctagaagagcacatggtctatagttggtacccaagaaattgaattaaaaaaatgaatactaggaatttaattatatccatatggatttgaattgattttcctcttttctgatattattgtttactatgtacccagtgagttctcaaatgcttattgagtgaacacactgaattttggaagttaaatatgagtcactttcaggggcttttgagtggtatttgtagaaataagtctcatgactttatattcctgccctctttctttgggcttctatgaaatatatctttggcttatcctagacttgctgagagcagcttaattatatcggctttcagaaacgtgagaatcaactaatccagactaacaaaacaagcagatacagttgatcctgtgacttcaagtaccttcccaagtggcattattaataaatcttgactcacagtactagcataatgcattatttttatagctaatgcatcaaaaagttatttgatccatatgaccatatgatttctaaggtcctataatctgagttctattctgaggagatatttcctatactttctagtgaagcatatgaaaggaaatgaagcagttctagtcattaaataattacttccatcagtacatacatagtatcgggtaataggaatatattataatagctcacctcttctatattattcaaataccatttgctgataactggaaataagaaagaatgctaaaattgattgacatctaacatgagttgttacttattatgggtcagcatcgaagctcatatatagaagagacgatttgaaatgttcagctagccatcttcataggaattacaataagttgaatatttctcagtatctttagtaaagatgcctatgccttatttacagtgtatttgcaatggaccaagctgaagctgtataaatgagacatatgctttgtttccatgttcactgttgaacttatgctccagaaagtcttccttattctcttctacccataatcttgcctctttttgaatccacatggcattgattttagagctcatttgtgcacttttcttgttctgtcttcttttagatttctaccaaattgtaaatacctatagggataggagcctcttttttttaattatactttaagttctagggtacatgtgcacaacgtgcaggtttgttacatatgtatacatgtgccatgttggtgtgctgcacccattaactcgtcatttaacattaggtatatttcctaatgctgtccctcccccctccccccaccccacaacaggccccagtgtgtgatgttccccttcctgtgtccatgtgttctcattgttcgattcccacctatgaatgagaacatgcggtgtttgttttttgttccttgagatagtttgctgagaatgatggtttccagcttcatccatgtccctacaaaggacatgaactcatcattttttatggctgcatagtattccatggtgtatatgtgccacattttcttaatccagtctatcattgttggacacttgggttggttccaagtctttgctattgtgaatagcaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaaggagcctttcttaatcatcctgtgtctcctgctatgataagcacatagcaggtatctaattgtagactctctgaattgataatcacttatatagaaattaataatgacaatatcttcttaatcccaagaataattacaccatcgtcattgaagtgaaaagagaacatttaatttcaagttttgaagtcttttaaaaatagatattataagctgatttaaagtagatcttttaacctgtcaccaaaagcatttattccagttaaaaacttgatccgtttatatattcatgcataatttatattccacccacttccaaaaattaattgaataggccactaaggtgataggtgatgccagttaaggaaattactaaaatatcagtaacaaaacctaccataaaagttttattcccaaaatcatcttggtatttttaaatgtttctaggttaaaatgttaaccacatctatatgctttatttctgtaccaaatagagtttgggaaggcttatttattagacgttttaaactagttcctagtttattatgtgattctatctcaaacatagcattttatattatttttcttttaattgacactgttttgtaaatgttaagaactatagagtgaatttaaatgtatatttaaaaacctacgtgaaagatactttaactcccgccttcaagtgaattcaaataaggagaattccaaggagtggggaaattagccaaacacttttccgtctcaggaaagccataataacaagaattataacctgttcctatttttcttaataggtgatttggggtaaggactccaaggaaacaagagcgttctgttctaagacagaaacatgaggcaaatggagacaaaaggagagaggagaccccaaggacaatagcctcccacattctctccatccaaggcacacatgccaaattgcattattccaatgagctctgcacaattaacctgtccaaaggggttgcgtggctgatgtttaactttccacccagctacgttgaaatgtacagtacatcttgaacatgttatttaaattgaaaatgaaacatctggacacatcagtacgagacgggtcccactaaatatgggaacatgtttacccaggtgggttcaatcataatttctactccgtgaaataaaatttcaatctcgcctgcaaaaactaaaaattaattttagagttttctttaaggaaatttttctcacagaaagaatcatatttcaattttaaatattggataatttgatcaaatgcctttatattaaatgtgctaaaaagggtttaagataggattacaattagaatttattaataataaatttctataaatagagttatatataagcagtcaaatcagagaaggcaggcaaatcctgtttgtccaataaagataatcatgtgatgaaataaaaaaaaaaggagttagatacaacttttttgagatgtacattgcccattggcttttagaaggcacatgtaacaaaagaactttgtcattcataaagaaatccataagtaattgggcatccacgaataatgatagtgagcggcaaaagttaaggacttcattttcaaagtcaatgttgtttatcaaggcctggaaaataaacccctgtttatttctaacacgccaaatgaaatcactgccaagtgtgagatactgtgataacctggaacggggagagaaagatctgcttgtagactggaaagagacctggtgccctgacctctctctgatagctgccaacattgccgggtctacgagtaattcagtaaactagtacgctccttctcaacatccccaccaaaaaagtcctttttccaatgtaagttcagtgctggtcggcctgtaggagtttcagcaaagatgagaattaaatgtgcttgcaggcaaaaacatttcagaaatattggctaaaaagtagactcattgcaacctgggaatagaaataaggtctcatgaaaacacttaaaaggaccaagcagagctttctacttgtaaataaaggcttctgttgtgtagtacagacagggcttgccaagcctttagcttgagtgttcttggaggggcaaagggaaaaaaggcagaaagggaaaagaatacaaggaggatttgggcaataaaagagacagccttgtatttgtacttcctcctccaccaccactgattccatcacactccctagctcaccctaggctctcctgaaatctgccccaagggttccttcttctttagttgtaccaatcttcgtattttctgtgaatggtgtcttgagaatgcctcacaattttctatacatccttctctgcatttggtatattttgtgtgactagctgcaaactcaatgctatttacaagaagtttaactgtcaaacacatagaggacaattctggagaggttgagcctagaacatgccaaacaacaggtatatgaaaacgcggggagagaacagcctattctccttgtgctgatgaactcaatctagtgaaaagcacaagtagcaaggtggattagggctggaggtagagctaacatgtatgagccttggttcctatgaacttgttcatacacgaacaggttgaggactgggtctctgccagaaaagaaaagaacctcccttggttcctaagataactactccaacccatagttgcctaggattggcctgatcaatgccttcctaagcactctgtaacacctcataactttagcactaacacccacggccttgatctatttttctgcacccgttcctatctgaccaggctaatctgcttcaaaactttgctaccatttattgggtagccactgtatgcctgctcatgtgttaggtgttttacatatatttgctgtgatccttgcaacttatattgttgcaactgtaaagtgtatgttactgtccccattttacagatgaaaaaaaggagacgcagagaggttaaaaaaattagcctaagcatgcaaaaaatgatggtatagctgagaatcaaaccaaatcagtctggctcccaagtcaatgttcaacgcaccaaaccttagactacccaacagatcttcagtatgctttccaaagccttccacgattccactgctccttccttccagctccttccttccagctccatctctgaccctccttgtggaggcaatagttaaatacttgttgtccaccatcccccatctcttcagtgtgtttatttatgctctttcctctgcctgaaataccactctccaatcaagcttagcacctcctcctctttccagatgtggtttcctcaagaaagactctctgatacctctctcatacacaagcaccctaagccatcttcatcagatcactttcagtagtccactgccacaatgatcaactttaggtgtgttcccacctacacagtagccttccaaggtaagaaacctgtctttgttaactttcacatctccaaaaccaggcacaatgcttggcataagcacaaactctgagggtgcttgttgaatggaattcatctgaaacttcagaagtgccttcccattgtgtcagggtgtgtgtgtgtgtgtgtgtgtgtgggtatgtgtgtaggcggaggaaggagggacagtgtgtgtttaatcttctcaactaactttcacatttttttgagagtagggtcaatgtcttctactttcattagtgtgcttgtctttcaaagctccttgcctactgcagacagcagagtgaatggccctattttcatgtcatgttaaagacacccatgaaggtgaactgaactatacagaagagaaaggtagccagggagctgataacaacagagaaaaatgagaatttactcagcaggtggatctcaccaacttgcagaaggctttaagattctaacaaaattaaacaatataaggctagacaattaagaataaatattgaatggagacagcctaaaaagaaaagtaggtattaataggcatttgaaatgaaccacttacttcaatttaggcactaaatttagtaatgcttcctgacaaataaaacaaagtcagaagccattcagtaccatgacttaccagtattcgttcacagtggtttaaacatgtaagggctcattcctctcatggggatctaaagccagtggccaccagccctgattcggtagctggatcatgtcagggccagcatctctgcaagtctgttggtcttttccttgagcttcttgcgctgcaagacagctgctgctgttccagacatcacatccaggtttaaggcatgaagaagggaaggaggcttaataaaccatgtctgatccttatattaggaaaagcaaaagcctttatagaccacttctgatgttttactgattcgaactatgtcacatggtcactcatagctggaagagggttttaaaaacatggcttacttgcagctaggcacattgctgcccagatcaaaactggcattttgttcgcaaggaggaagaaagtaatatgtactagattaaaaactacactaattgcagattgtagttttcattgtctgctaaaagacttcatgtaaaccccagaagaaatttattacacactttaataactagttgatgaagtaataaatacatgtttggtcacctaactgaattctttggaaaaaacacaaactttttctttattttttataaaagtacctgtgaaaattttggaaaataaattataaaatataagaaaatagtgacctgtaatcatgtcccccagagacagaatattttgtttgaatgaagaatgcagttatatatgtcattatagaatatttagaaattactcagcacatataattaatatctcataattctaccacccatagaacatagagcaattttggtcattttgaaaagagaaaataacttttcacaaaattttaaattatatactttctttaaaaaatacagacattgaaccaaaattttctataaagcgtaaatagcatggccataaatttgtgtacaaaatttaatctgtctcctatcattggacatctaagttgcatgcattatgaagaaccctagcattaacattattatagataaatttagggacaaattattattctttcctagggaataaatgctagaagtaaaactctagtggcaaatgtattaaaccttttcaagatttttgatacatgttaccaaattacatatgatatggtttggctgtgtccccacccaaatctcaccttgaattgtaataatccccatgtgttgaggggggcgccaggtggagataattgaatcatgggggtggattcccccatgctgttctcatggtagtgaataagtctcctgagatctggtggttttataaatgggagttcccctgcacagttctctctcctgccatcatgtaagatgtgactttgctcctcattcaccttctgccatgattgtgaggcctccccagctatgtggaactgtgagtcaattaaacctctttcctttataaattacccagtctcaggtaagtctttattagcagcatgagaacagactaatacatcatgtcagaagagttctacaacgttcatcttaataataataagacggccatttttcctgaaacctgggtaatgtctatacatatgtatctgtgtgtatttatgtatacttacatgtatcttatccaatggcaaggttatatatgtctatatatagattattatgtatatataatatagatatagatatatatgagatctatatgtaaacttgcagttagataagttaaaaactggcattaaataattttgcttaaattagtttttctgtgattacttgtatgagtaaacatgttctaaagtggcttattaaaaatgtgtgtctttttccatattgcctgtttatatactcgtctgttttccattgagatagttatatttatttgtatgtgtagcttcctatataaatagtaattcttatttatgaaagaagtatacaaatataataatttatttttggatttctaattttgtttatggtagtcttggatttctctaattttaaatatagatctttttggaagcttttaaagaaacacccatgggtagtatattttcaaagtcattgcacatatgataaaatctttctattgtcttcacatatgccatggacggcaactgtctggatatatgattttttgttaacatcctttaatgtcaaaattctagttacttccttatataacttctggaattctgtgttgtatacaattctttgttaacacccttttaaacttcaaattctagttatttctctatctgacctcaagaaattaatgttgtaaacaaactgtctaaagttagtctgacatggttcctttgtagctaacttttcccccgtgtgttctggtttttttaaaaaaacattatcttttaaaaagggaaaacccctgagaggtagtttgttagcatgaagtcttctcttttttattaaaatttaatatctcgggggcacagtgagcatgtttaaccttagcatgtgaatctttttagtgcaaaaaatatttctttagctatgtcttggtcattgctccttaaataggtgtacttctttaggaatactggtaaactttaagtgggttttttatatgttcttttatatctgctatattttacatccttgtcctcaactctttgtcctttttagctacattcctaaagatttcccagtgttttctctaggtctttgatccagttttctatagtattaattctgaccttcattatttccaatgataattcagataagtctattgcacttacagttttctttcaattctaccctattttacccaattcttgcttggttttcatcctgattttttttttccatttctttcacgtctttctgctcctgtgtcatgaaaggcatgtctacttgctgcctatttcaggagccaaatattaaatatcttcttttagccatgacagtaatttattttcctatgtgtccttaggataatttccttattctgtatttttttttcaaaattctcacatataggatagactgacatactcagtatttccaattaacaggatatgtgattggcctcagagctctcacttatttcagtgttgatcgtggcagattctcctagccccctgtccagtgtctaggtagcattcaactggagtagttatgctagattggtgtgatatcttttattctcaatatctggttctttgatccataaatttgaatgctgttggcccttctaaaaattttaccaagtgttttccccaaagagttttgaatgccaccttggacttccacttatagaactgctagaaatgtgaccatcacagacgtttaacgaagaaattaaagtagcaaccgctgctaaggtttttgagctggctggccacagaggggatgaccttctacctataaagaattcttctctttaggaagaagcagaatgaagcaaagcagaaatagaaaaactctacattcatacttgggcttctcctatggatttaaatttacaaactagctaaataataagtaacaatgtatactcaggagcataataaatctaggcattctcctatatgattcatctattcactattgactatagtgtatatgggatcttggtgggggaaattgtaattactcatattttaataaagacagtggtactttattaaaatatttgaatttgaaaatgttttcaataggcggaaagccacagcccagctcatagcagatgactgaatgagtacagacctttttttgcaagaataaacctgaaaggggtgggagctgagatggaattggggtactctcttcttcctgtctccaagaggtagcctctcagcgattggaagagcacattgagctgagaaagctctaggtggacaagtcaagctccaaattgacccggcagcacaccccagggagcagctgtatgcagaagcactttatgagtttccaattgtgtccacaatctattcaattccagcgcactatgcttatttactgtacttacagcaattggtagttttactgtacacaaaattcctagttttcatggacagttgcctcagtgcttgagatttatataatgagagagaagtgtgcagacacaatgattattacacatcccgttgtcctgagctgagcaatgaaatagaaagcagaatgcctacattctaatccagccttgggccctgtctgaccttgggagtgttcctgaatctctaagtttcagcttccatatctggttgaacgatatcatctctaaagtcctttcagctgtaacaccctacgattctcttttcaaatagagaggacatccttcctcttaccggacactaagagggtttactttgcaaatgtggctctcagaattttatagttgttcatttgaacgtaaacagaaaatttgtttatgatgttcttctccatactgtagtttgggataagaagggtgcattttttcaatatgttcaactttcaaaaagacatgctggaggaagtcagccaatttctgcccacacaacttccaagtgacgtcaatggaagcagagcacacagatctctaggcaagttttggctcattatgtgaaggtttttttttttttctttttttaaagaacaactgcaaaaatgattgctctcaactcaaattacacaatttgttcttctttgtgccctgagtcagcaatagacataatgtggaaaataaagcaaaatctcctttttacacatcaaataaaagagtccatagttatctgaaacacagaatatttgagattttgagcactctctaagcaatatttcctcttgctgtggcctctgcttaatttcaatatagaaggttgatcaatgatcatcagatggacaactggaaaaatatatctactttttcttattttgatcctagatttgttcttcagtcctgcaattgatcttgtatatcattggcttattgcttaacccttggaagtattttaaaggacttacctgacaagcagatataactggtgttttgttagctcagcttttcacaaataagtcaaatagttctgttactatgactagaagaagaaaaatagctaatagaaatgtagctgttagtatataatcggcacatcctggctcaattatcacagcaaccctggaaagttgatgttgttattctcctcattctactgattaggaaacaggatgagagaggttaaataattttcacaaagtcacagcactgagtaagtggtatttagattccaaaccaggcagtctggtttcagtatctgtattcctaaccacaatgctatctagataataatttattcttctaatcaaaaagcatttaatgatgcctaattattctaggctctgagtagagtcagttactaggtaatgtggaataatgacatgggaacaaagggcaaagataagggagggaattcagattttctttgcacctaaactggcccaaacactgtactcaacacctcacatctatttcgtctttgcaaaaactgtataagcaaaggttgtatcagtggcattttatggatgaagaaactgaattgtaaggaggttatcacttgctaaagattgcacagctggtaaggcttggtaaaggcttgagttctaacccatctgtgtgtttctaccacctacacttcctgtactccaatatgctgcttccaggagtatgtgcaagtgaaatactcagtttagtgtctgagctagaatgaggggcacacaaagtttctcctaatattggggaagctctaaaagttgtttaggggtaatgtcaaccaaaccaaatttctacatttcagagcttctcctatagtattctactttagtctgcattgcccaaactgtgctggaaggactgccttcaagttcagggccaaagaggtccatgaacaaattgggacataattccaatgaatagcacacacattagaattaaaatagcatcaaaacattaaattcctttttaaagtggtaataaatgagttcagtattttatgtacaaaatcttgtatttttagagaaattaatagaaaacttttgcatgaacttgcatagcttttcatgagcatgtacagaaatgaaaactggcatcctctatagggtgccctagaaggaccattctgtaaacattagaaggtgaaatatatgagaaatctgtaagaaagtacttttcatttttccaaagcaaaatgcaatatagatttagagttgctttatttttcccttttttatttgaatagaatgcttttcctaaaaaatattaccaactaagtaagaggcagtttggatttaaattgttctcctttcagagtttgttcccatcacatcaaatgtcttatttatattcaaataccacagggaatgggcaagaaattgtatgtttaaactggactttttcaaggcttttaaggccagaatattttctttgccaaagactaaattattgcaaagtggggcaagcacctgaccttgtggcaagtcagaataagtaaatatctccacctggaattggaaaccaatgctcccaagaccccagagcatcatttattagcctgatggcagctttctgcttgttgctggctgagcctgattatacatatgaaaaatgggaatcacccagagattctctcaccctaacacagagcccactttgcttatgtacttgctcttgcaaattccattaccttccacgccaccacaaccccttgaaaacccagaaatacttatagacaacagattaccccagtccatcctttctccatttccaaatgggcattctgattacatttctaaccaactgtcaatcaagggggtctcaataaattctctttccaaccatctcatggtaatagtatgatattaactatattatatcaaacactgtgatgtaaaataactttgacatgtgtagggacatagtcttacttttagtcatagcatcgacaaaattttaatgcatttcttaacttgactctccttcatggggatatacagggtctctgaagagatctgtgtatacctgatcagagactggccattcctatccatcctgcatgagtaacacaagatatgactcactgctgttcattaacctcatagagttcatttaccttctgcagaagtaaaattgatttgctctttgtaaagctgggtgacagaacttttaggattcctggaagtcacattcaggggtggttcatgggcatggaatctgtgcagttgcacagggtcccatactcagaaaggctcatgtttggttggtttaacgttttgctgtcaccatcttgaaatcattaataacttctgaacaaggggccttgcatttttattttgcagtagaatctgcaaattatgtggccactactgaccacattatagtatcagtgtagcaaatacagttgattgaaaataaaagaactaaaaaatcaaccaagtgccactaacatatttgagagttttttccaagtaagatgttgcatttagtaaattgacctgagttttattttattttttggtaaaatagtcccgttttttagactgatgtaattctcaatgtgttatgatgcatacatacatgcgtgtgtgtgtgtatgtgtgtgtgtgtgtgtgtgtgtgtgtgtgtgaatacatttttaatggttgataagaaaattgagcaggagggaagtgacaaaagagaaacactaaccagattccaaagtctttttacttagttgtggctaaatgcttaaaacatccaatacggtctcctttcactataatcatcacgttgcctctttcagagaattcacattcctgtcttatttttggattattgtaatttataaaaatattgcagatgtgcaatatgtcactaaagctgagcttgaacatggccgaacatcgtggaagcctagtacctgaatgccttcctaacagtcagccgagcacagcccgtcttgccatgtttctctttctttctctgtgtgggtgcgagggtgtggggagtgggccagcatgacgctaaacgcactacgcaaaagccagcatgaatcccaggcctttttctggacagaaaggactgattgtgtggcgagcagctggaatgcgtgccagtcacttttggagtggtggtcacaggcatcgttttgctggattgtttgaggagaagcaggacagaagggagctctcctgccctgtgctgcggtgaccctgtaattttcctcctcttctttgttcaaattataaagaagagtcccacatgttcggaaaacttcagcccggttttttcaattggacgctgctgtttcaaaagtacaaccttctctttctggttgcttggaagtgacggttcaggaagtgtgcccacaatgacatgagttagggaactccgcagagcaggcctatggtggagactcaggatattttagtcagggtctgtggataaggcccatgttaggacagtaaaaagcttgaaaaagaagcattttagagaacttattgtataaatggttaacgagaaagccagaatgatttgtgatatcttaaagtttattttaaaagtttcagattctttacaaaacaagcaaaatctttacccgttgaactacttatagatctactggctatgattttacaaagttagggaaactgcaagctctccctttgtcctactgtttgatatttagctattatcccatcagtcgaggtctcagtcttctgaacagtcatcattttacaccattcccaaatggatattctgataacagaacttacagctcttgcccacccaatctcacctaccaagaatagagattatagatgattataccatataagaggaagacgctagaaatgtcttccctattttgttatttttgttggattttattcttcaaattaaagtaagagagacttgaagttctggattatatataaattctctgcaagcacttgcttgactaaatggtatgaacgtacttatatagtgtcctgatgtaatgactcatacaaatacttttcatagcagaaacatttacatgtcttcttttgactcaaatgttaatgaggtttgttttttttttttttttttttttttttaatcctctaggcttttcccaggatgtcattgtggaaaggtggttaatgagaaatcgtttgagtctaaatgcatttttacctttcatattatatagttggtagggtaaccaaacttaaccagctaaattgacccctaattgcccacctacctattcttcccagctcatgaaaatctctgaaatgacatggcaaggtcagaggaaagcaactgatgaatgctggtccttggtgaactgcaaactctgttcctacatccaggaaatctctgctgaaatctctgctcagctctcatttggcctcctagctacagctttctgctgctgctttttataaaattcctggagaccctccctgcacatgcaggatttaggagtcagccaacaatttaagaagacttggtagagagattttgacattccttccacctggctcttctttgagactaccttccatttccaactcttctagcagccctaaactctgacctctgtttccttaaaccagtaaaattgtgcctttctacttggattctctcccctggcaccccaaagaattacagagcttagttttcacggatcaggcctcttccagtttctgcttgctttggttgctcagcggtgcttttagtcaattatttgtttatattttgtctagtttctatagttgttatcagaggagaattagtccaatacaagctactctgctatgctcaggcctgcaaatctcaaattactataattaataagagaatattagaaatgtgctggttaaaaattgaatgtacaacattaactgtttctatatgcctagaaaaagtagttagacaatgtaattttaatttacatttacagcttagtacaaggatataaagtacagaataatattcctaaaaatacatgtaatactcttatagataaaattataaaacttattgaataaacagttttgaaaaactttgaagaaaaccttaataaagacagatatatcctgctcttggatagacttgttataaagaagatattcattcctcctatagggaggaaatgggcaaaagattgaaaagacatgtcatatcaaaggaaatagaagatggcccctaaacatttgggaagatgctgtaactgaaaatctcaggaatgcaaaattaagttcttaggagatattatttcatatttaccaaattggcagaaatttgaaagttagataatattttgtggagtattatgaagaaacaagaaggtttgtcaactgcttttttttttttttcttgagacggagttttgctcttgtcgcccaggctgaactgcagtggtgtgatcttggctcactgcaacctacacctcctgggttcaagcaattctcctgcctcaacctcctgagctgctgggattacaggcatgtgccaccacgcccgactaattttgtattttttttttaggagagaccggggtttctccatatcggtcaggctggtctcgtatcccaacctcaggtgatcctcccactttggcctcctaaagagctgggattacaggcgtgagacaccgcacccggcctatcatctgcttttaggagtgtaaattggtccaatttccttagaaactattgtcatcacctattttacaattcagtaagtttactcctagatatttacctaaagaaacatttacatgtatctgtataaaaatatttataagaatatgttaaaaaaaacaaaaatgaaacactggaagcaactgaaatgtctaccaagaggggaaaggataagtacattgtattatattcacacattagagtacaataccacaggcaaaatgaataaaatagagctatatctcaaaatggaggaaacttgaaaatctaagtttgaaagaaggaagcacaagtatccaatttgttcccatttgcaaaaagttcaggcaacatacaataatatgctgcttggggaatacctatgtaggtgggtctagtgagaaagaaaagaaagagaataagataaatttctgaatggtcaaaaaaacaccagcatcaagtagaaaagtctgttatagtatgaacgaaatcacagagaatttaccacaagtttacctggtatctccagtacctagaaatatttgcctttttcaattattataaactaatctatgcatgatcaagataagtggattttgttagttaaagcattaagttatcaaagtgaactttggatcttatgttagttatgacaatatttgagaattcagttatgttccttaacttttaatataaatgactttgtgttttgaattgttgtggggcatgtaaaattgttgttaaattactgtgaaattttaaaaagaaaaaaaaattcggagtggtcatttcctctggatagatgaagaggaatgcgagtgtgtagagaaacagaagggatctcagaggtgtggtgctgtcatatcttctttcgtgccctgaagatgggaacatgggtactctctgatcattctttaaattgtgcattaatagttatatattcttcctataatcccagcactatgggaggccgaggtggacgtatcacttgaggccaagagtttgagaccagcctggccaatgtggcgaaactccaaaactacaaaaattagctgggagtggtggtgtgcgcctataatcccagcttctccagaggctgaggcacgagaattgcttgaactgggaatgtggaggttgcagtgagccgagatcatgccactgcactccagcctgggccacagaatgagaccctgtctccacaaataaataaataataaataaataaataaatattctctttgtatgatagttcataataatcatatatgttatttttatatttttaattttattttatatttcaccaagtagaatttttaactgctttctggagttgctgcgggaagatcaaagtgtctacgcaaaagtggcctggtgatagggtggggcccagagcccagtgctggtggagacaaaagtgcaaggtacagcattgcaaggtcagcagccgtagactcggatcctcggcaaacgcaggtgtgatcttgggactagctctaggctgaagagctcacatctaattctccagcactatgagccagctagtcttgtaatggcgccctctactgcttacatttgcaagagactgttcctgttgcttgctacctaaaatcctgacaggtgtattgcttttgtagtgtctgtgggaataggtgaggatatccaataaggacacttgaaatatgagtttgaaatttaggaatgatgtctgacatgcgatatagctgttaccaatatacagtcatttgtgaacacagctaagttcaccagggagggtgtgaaactcaaagagtatgaacctcaaagcttacccactacaacatccaagggggatccaactcctcacttaccaatatctgtgcttagatggtgttgggacaatcttggtatccacaggtcccactcctctagaagccagtatcacagtcagcactttagaactgtcagtaacaccgaggttatacaagtaactactcactaattgtttgttttttgttttgttttgtttttcacttttaaagactttcttttttacagaagttttaggttcacagcaaaatttggaggaagatatattccccataagccacttgcccccacacaggcatagcctcctccattatccacatcccccaccaaagtttgctacagttgatgcatctacaatgacacatcattatcatcctaagtccatagagtcccttagggttcacttttggtgttgtacattctatgagtttggaaaaatgtataatgatatcaatccttctttatagtgccatatggagtattttcactgccctaaaaatcttctgtgttccagccactcatccctcccacaaccccggctccacccactaccttcaccaccccctgcccccgcatctaacccctggcaatttttaaactttttttattgcattatctcgacacagccaaggagattattttatgagaatattaatgaaaatttccccaagagtaaccccatattcttagaaaatatctgaccatcattctgcatgattaacctacattctggtctcagaagcatgactaagaaggagtttaaaaaacagattggtggggcagtaattatgcagttgataacacaaggctctaccctgtgtacataaatctttcacaggaggaaaaatatttaaaatgtaagaattaaaaagcaaaaacatttggctataaaaagggattcagtaattacaatgaacatctcattaaacatagtctttatttacaagaaggctgggagagctctaattaactcataagctgtccctatgaatcattagctgtggcaggaaaattctaggtgatccattaaatctccacacccacagctgttcagggaaaaatataagcaaaccctaactgcccttattttggatggttggtgaattttcttcagtgaccaactggatgaccttggccaccacacatcatatatttcttctccccaggggaaactgaagtcctctttttctataaccaaggataggattttctcaacactcaacaaatagtttgtccatctttgaacaaacttttaaaccaacgtgatataaacaatttacaaaagtttatggtagactttagatgcaaatccttgagttgacccagaaacattctgctgttttattatgtcagtttcctaagtctgtgtttgaatatgatttttcaccatgctatctatgtgtttttgtgtttgctgtgtatgagaagacatggtctaattattaggggccaggcactgtgaacctatgcagaaaaccacaaaagtccaaatctgcactatccaatatggtaactacaagtctcttgtagattttgagctcttgctgtgaagctctgaattgagatgtactacaagacttcaaagagctagtacaaaaaaagtaaaatatctcatgaaaaattgtataatatttttgactactagaaatatttagctgctagaaatttttaaatttcatatatgtgccttgcatttgtagtatacataatatttatattgaatggcaggacaagtggccactgtgagcccaaagtacacatggaatatttttgaaaagaagccaggagttctagagctatagaatttcctatctggaagagatttccaaaagtaaatagtgtaaaagtgcttatatttgtccaacatagccctcactttccaccacacacacgttaacacatgtaaatgtccatgcatgcaacactgtgaccagcataagcgaagagttgctatacattaagagtttggcatcactggaagaatctcctacctagtacagttctctctctgtatccctgggttccacatcagcagattcaaccatggcaaaatgaaaatattagaaaaaaatgaaaaatacaacaataaaaaaatacaaatttaaaactcaatagagtataacaactatttacatacatagcgtagcatttactttttattaggtattataagtaatctaaagatgatttaaagtatccaggaggatgtgcatagattatatgcaaatactatgccattttatattagggacttgagcatctgcagattatggtatctgcaggggttctggaacaaatcctccatggataccaagggactatatttctaaatgttggggatttaaaggaagaatatacctgaaagaagaaactgagagaacaagcaggagagatcactggctgaatgaatggaaaagtgaaggacattccagaaaaggaaaataaaatgagcaacagctgagaggaaaaaataaacatgggtctttaggagaatagtgacagttgggctattagtaacaataattaatatctgaaaatagcttttaatttacatagatttcatcacaggcattatttcatttcatcatgatagatatctatttttatcattcccattttacagataaagaatgaggcccaaatttaaggagcttgcccaagatcacacagtcggtagtgccagaatttaggggatcaaccatcctgtctgccctgggctggggtttccagcactcaggactttcagtgctagaaatgagaacatcctgggcaaagcagggaacttgctcactctacccttgaacccatgtcttctgactctaaatcccattctctttgcattgataataatgacaaacatctattgaatactttaggtgtaccacgaactttgtaataagaacttcacataattatctttttaatctacaaaacaactttataaattgagtattgattttgcacttcctcctcctaccaccccacatagtccagatataaaaaaattaagtctcccagatcattgataacttacccaatgtcacacagctggtaatgtctggattttaactcaggccattccagtccagggcctgtgctgctaaccaccatgaaagatgcccagcctggtgctgccacctcacctgcttgctaaggcccagggttcctgctggaccttttgacccactcctttattttttcatcatgttagtatgaaaacatagcttgactggaatccagcgtccactactgcggtcactctttagtgcataacacctatgcctcctggctttgatcttgccagtcttccatttgaaatgacctctcatattaacatcctaccaatgcctgtcccaccttttagtaggtaccttgattcaaaaagagttcttaaaaagtaaaagaaaaaaagtttccttttcatttaacatgtactggcaagagttgccagataatttgtctttaaaattaaaacaattatgctttctttaataaaaccctagttttttgttatcacctttgatgtaatttttaaaaagctgttctttgaaagaatatgcattatttttatatggcagaactttacaccatttgaagcaccagaacagatataaaatgttacttcatgttatcattcccagtatgagaatgatgagcttgtcattttcctaagaccgtaaattcctgagtaaaaacaactatgccactttttttctgtaacccacacatcactgacatagtgattgacatatgttttccagaaatgaattgagtggagtatagcgttgagtgagtgtgagatctcactggcctcactggcacagggttgaagccagaggattttgagtttcttattgtctgtggctttaagccttgtcacttcttcctcctcatgcctcaaccttccacaggcatgtattctaaacagtgttgatatgtagttgccacttcagaaagagaaactgatgttggatatttaaattatttaccttttcattgacatataatttatatacattaacatttgtccttttaaattccttgagttttgacaagcatatacaactgcatatagaacacaagcagaatctagaacatttctatcactttagaaagttccctgtgctcattttttgtcgacccctgccccaccccacttcccagcactgacgtgaactgctttctgtccctatagatctgccttcccaagtcatggaatcatacagcagatagctttttggactggcttatttccctttttataatgcttttttttttttttttttttttttttgagacggagtctcgctctgtcgcccaggctggagtgcagtggcgcgatctcggctcactgcaagctccgcctcccgggttcacgccattctccgcctcagcctcccgagagctgggactacaggcgcccctaccacgcccgctaattttttgtatttttagtagagacggggtttcaccgtgttagccaggatggtctcgatctcctgacctcgtgatccgcccgcctcggcctcccaaagtgctgggattacaggcgtgagccaccgcgcccggctataatgcttttaagactcattcctggcctggcgtggtggctcacgcctgtaatcccagcactttgggaggccgaggtgggcagatcacgaggtcaggagttcgagaccagcctgaccaacatggtgaaagctcatctctactaaaagtacaacaattagccaggtgtggtggcaggtgcctttaatcccagctacttgggaggctaaagcaggagaatcacttgaacgcaggaggtggaggttgcagtgagccaatattgtactactgcactccagcctgggctacagagcgagactccattaaaaaaaaaaaaaggatttattcctattgttgcattcatcagtattctttttcattgctgattattattctaatgtgtgtataccaaaatttaactgcctattccccagttgacggacatttggagttttgtctgtcacatataaagtggccaaaacagcacgtaggtcttcgtgtggatgtatgttttcacttctcttgaataaattcttcggagtggaattgctgggtcagagggtgggtgtatgtttacctttatataaaactgccaaattgtttttcaaactccttgtaagactttgcattcttgccagcaacatatgacacttccagataatccacatctttgccagtatttgatgttgtcaatctttttaattttagctattcctgtaggcaagtctaataggtgtatctcattgtgggtttaatttgcattttcttgcaaatacctttaatagaccttttggggggtataattcgtatactgtacaatgttctcatgtgtcaaagttggtttagttttggcaagtgcgcaccccttatgtaacacacaccacgtccaggtatagacccatgccaggcccccggaaatcgctctatgctctgtccagtcaatttcctccatcacaaccaaccactgtcaacgattttttccaccatagattagtttcacctgttgaagaacttcatccatgtagaattatacggaatgtgcgtctgtctgtgggctggctccttttctcagcctgatatagtctgatggtcatctgagctgcagtctggtactgctgtgcattacctttctttgctaaggagcttccctttggatggatgaaccacaatttgtttagccattctcctgttgataggcacttagttgttctcagtttttgtctactatgaataaagctactataaacatttttgtgcaaggatttttgtgaaggcatgttttatttctcttgaataagtagctggggcagaactacacagtcataaagtaggtaaattttatctttataaaaggtcaccaagctgtttttcccagtgactttcccattttgcatttccacccacaatgcataagagtttcagttgctccacgtgctgccacagtttcttctgttttgttgttgttgttgttgtgttaagtttagccattctaatgggtgtgtggtggttttaatttatatttttctgatgagtaatcatgtgcttattgcccatttgtatttattcctttgtgaagtgtatctactcaagtcttttgccctttttttcttttcttttcttttctttcttttttttttttttttttgagatggagttttgctctgttgcccaggtcgcagtgcaatggtgcaatctcggctcactgcaccctccgcctcctgggttcaagtgattctcctgcctcagcctcccgagtagctgggaatacaggtgaccgccaccatgcctggctaatttttgtatttttagtagagatggggtttcaccatgttggccaggatggtctcgatctcttgatcccatgatccacctgcctcagcctcccaaagtgctgggattacaggcgttagccaccgcacccagcctgttttgcccttttttattgggttatctgtttattactaactgtagttaattgactggcttgtagttttaaaaaatatattctacatacaatttcattgtcagatatatattcagaatgttttcttcctatccatggcttgagagaagtataatatatcttcatggtttataatatatttttaatataatttataatacatatttaatgtaattcatatcttataaagtatctgatgaacggatgttttaatttggcagttgaatttatcaaaaaatacttatagttcatcctttctgtgttctatgtaagaaatctttgcttaacccaaggttgcaaagataatctatgtttccttctttgtagttttcacttaatttaggtctacaatacataaaattttgtgtgtgtgcatggtaaagtaatactacattattacgatgattgcagctttatagcaggttgtaaaatcaaacagtttccaacattaggtttcctttcaagatggttttggctattgtaagtcctttgcatttccatgtgcatcttaaaattaatttgtagatttttacaaaaagtctgcagggatttttttcaaccttttcttattctttgtttgcataggttatttttttttccaaattttccacgtcacttatttttttcttctgcagcgtcacgtctgctgttaagccctacccaatgaatttttaacgtaggatattatattttttaattctaaaagtttcatgtggttgtgttttacagtttccagttttctactaagatttgttatctgtttacccattatatttctttggaatccttaaatgtgctgttaatagctattttaaaggcttcatctgctaatttcaacattgtcatttcaagtctgcctctattgatttgttgttgttttttttttattgttgttgttgttagttaaatttttcatttcctttgcacatccagtaaaattttttgatatgctggataccgtgaatcctaactggagaatctggattttgttgtcttcctttaataattgttggattttgccctggtaggaagttaatttacttatgaatcagttgcttcctttaaggcctgtgaataagctttgccaggacatagtctgcagggctaaagtggcctccctcttaaagtatggtgattggagatctcagctgcatgcccaaggtgtcggtgagcccgctctcctttggttggccagaactcttgtgactcccagctctttgtggccctggcatcttcatttcactcacagctccccaatagagctacattgttgtaccttgtagtttttccctggacatgaacgaggaggttaatatttgtccaagtcttaaaagaacctttatgcagatttctggtctttcttctctatgcagtttctagttctcttctctctgggtggctggttcaaaattctagcctcaaactcaaagtgtgttcctcctcaggtcagcaagatccctgggttctgctttggctcctcctccctgtgcctagacagagagctggggcaactggagggctcttatcatggtattcctttctcctaggaaccataattctgctctgaatgttttccaacatctgaaacagttgcttcaaacattttgttcagttttgtaatagtttatggctggatgaattcatcattactgattattttgtcatggctgggaatggcagctacccatatcattatttatgaatctaaaaaaaataagtatactaggcctaagacattttctttatctttcacatctggtgtcatctctgaaaccagaattccagttttgtttctgtaccactactagaatatgtgcagctatgaagcagagtgaaagtatttgcaaaagacagcgtatcccctcctgtaagatgaaagtccattaaataaattaaataaataaattttaaataaattaaaaaatatttggaatttcaattttatttaaagcaagtttacttttttattataaaagatagctcctgtgggtgacttatgccacacaggtgtttaaggtggaaatacaatatcttatggcattttaaggcattccatttatgcgtggacagggattactatcagatttctctcatgtttgaaatatagtatctaacattttataatgaacaaagtgtttccgatcagattatcactataagttggctagtatgttttcacatgggaattgttttgtgttgtgtttatttcctctgcggtattatgggaaatttttaaagctaactgccttatgtattcattttaaaaactccccaaattattattcctaataaagggaaatatgaaagtatcaaaatattattatatcactttttcagttcaactgagtatgggagttactctcccgggtaaatgtgtgttcagcttgtggaaagaatcataaatgtcttctcaaaacaaaagaactcctctggctataataggcagagagaacaagccaagccaatctttccacttgtgctaccgaacgcctccttttttgaaagttttcagtttcaatggaaaaataagggcagcagataatgaaccctttattcattttgacctaacaagaggccttttaggaggcttacctagggaaccagtcttccagatgttaccaacgtgactctgtggcttattatgacttcttgaagaactttgctaagaaaaaagaaatatctaagatactgccacccaataaaatgttatgaaaaatttctacacttaatcatgtcctcactgtgaatcgctctattagtccctacaaccacatatagattttctctcaacatgacagtagtacatccctactgtgactacataatcctcattagattacttgtgtcatatttattacataggtggtctttaggcaaagcatactatattttctttttcctagtgtttcaatatgaactgcatgggcagaagcagcacaaaatagaagagagtttaaattctgatcctgccatttactaaccaaatgactttgagcaaattatttaacctttctatgattgactttatatgttaaagggttgttaggatagtatctgatccacgaaggagttgcgaaaattaaaggagttaatacaggacagaacagtgcccctcacattgtaagcactgaagaaactctgcctcatctgttgtttttattattattatcattactaccactactgtttagagaactctttaaaattagctcatttagccttcacaagaaatctttaaagtaaatattgctatccttattttataaataagaaaaccaaacttaaacctaggtctcctgaccctaaaaggttatattcttgtcttaagtatcctagataatgttgaaacattcagattttttaaaaagtgatcatgagccttcactaattttagcttagtcattttctttaataattttataagaatatttgtcgtgtcatccaaaaatttcattggcaaaagagaattcaagatcataatgcatttctataaatagaaaatgtgcctatatctgcttcatatcatttccaattagaatagagaacacatagattatagaatgagaaaaagtttaaatatttaacacctaggttggcatatagcatgtcaagtcctccccatgcttctttttccatctaaatacatgtatcctaaatttctgatctcttagtcttttgagaagttatttctttgatcctagttttcaacatctaggtatacatgaccctccccatcaatgtgggcagtttgcttttcaaaccatttgcagctccacctcctaaaagaccagtctctctggactatttttgtgtcacccatatgatagtgaatgtttttccattcctagagcaaagtctccatgagtctaacgatgtttcagaaaaagagtcacctaaatgccagtaattacatcaagttatcaacccacagaaaaataaccacagcatatgaagttctcttggaatctttttaagaatcaacttagcctgagtctgtgatttaggttcctttccacgtcttttaagagctaagcacaacctaagtagaggaaaagtctttgaagtacaagctggttgaccatttcctgcgcagagtatccaatcccattgaaaatgtcttggaattgtccctagcttcatcagtaagtgctgggggatgacgtcactgcgggatttcaaccgaactttatgttctgataaacaatgtggtgctggtagtggccactggtgaattctttttctcttgggaggtgccagcaaagttccttataaattttcaagctttgttaaaagaataatagagggtaagacagaaagagcttgggggtggtcaggccccgaggaggatcgcctattaaagtcagtgagtgtagacgacaatattttggtttagtgccacacttctttgagtataaaataagaaaataactgtcgtttcttggataacaggctatttccaacttaccatcacttgtctcgtgtgtcagtcttcatcctaaccatgtggcagcatgcagatgacaagggttatcttgaatttaatccttttcttagatggacagatatattcaggaggctgtagagttcaaaagtggtggtaaaagcccttccagtggcaacaataacgatgaaagaacccaacaggcagttttgtaagctttaccctgaacaaaagccaagagaacattgcttgtaaccaaacaaggaataaaaataatactagagtttctacagaaatcagtgcatggaaattccctgcttattaagctgtttccattatgagatgttcccctatattaaaattttcatagcataatatatccatcatctggacattctgaagatttttttttcaaggaaaactacttcagtaattctttataaaaacaggtttccattttctttaagaaacaaggctgatttgccaatgaaaataaataaatagaatatatctcctaatttttattctaataccttcacagaaaattaaaccaggtaccaaaaagtcatagctattgggtaggttgtgagtgtatcaaatttggacgaatattatcagatcctaaattaatacaatcagagtctctttctaccctgttctccacatccctttctactataaaaaaataccccttatactttcatcccaacctcctatccttcccaaaagcatccccaaaacaatgaaaaataaaacttactggagtagactgagaacaagcagtttagaactctctccctcattcaattcaatgtacctgaaatgagcattagtattagaactcaattcatgagggttatttttactgtagttatatgaaataaatcttggggatttaccttagagattgcataaggtcaatcttgcatccaagtttttactaacattgtttattctaactcctgtttccttttaccctcctgtaaactgccacctcaagatctctcaagcctttatttcctcacatacaactctgggtaaggtaagagaaaacacaagcccagagtggcattttatatgagtcagtaaggtacacccatgtatcaaatggcatgggaaccagggaatcattttgagttactaggttcagtagtgaaactctgtagttttcttggcccttacaaaaccaggtcacagctgcctggcttcctaatttggtttgatgtactgtgaattcccaagggggtgagtcactctcttattcatatggaagtacaggagccattccaaaacaaaaaccagtctgggtttatttatgattttatatgccctttactgccccactatacagatgatccagagttgactttcagctgttaattaccatattggagaggagatacatggcatttttcatcttttgagttacaagacttctttaatgtgaatattccctaagtgcttgcttgcttctgcttttggaatgctttactgaggctggatatatattatgaaacaatgaatgcaaaatcaatcacacatggagaaaatcaaagtagtaaaattaacaacataccttaagaaacagtctatgttaagtcagtgtaatagcatcattatacattactcttgttacctattaagtgctcaagaaaaccataaataccttgctttatagacttgatgaggcagaaaaacctttcctgtgggtcatcaaattaagatgcagtatgactttacgatttgttccatcttagaatttggctgtgttctatctttctgatttcccagagccgtccacttcaggatgtttgggcttctgccagtggccgtggcacagatgcttttaataaagggatccaaccaccttctggaaaacctccctgcttcactagaactttcaagagatatcaatcctgttttattagtgtttatttaaaaagaagaagaagagaaagaagctgaagtagccaacacgatctatgtagtctactttatgtcccttcttttgtcacacaaaatagaatatttctcttgaaaaaggctcatacaattccgtagctatatactgagtgcctactgtgtggcaaactctgcactaggcatggagacaccaagaagatgcatgacttgccttagagctattacacagacgcagtattactttgtaaaaatatctgataactaaaattaatctgtaaggtatatagagatctttgtataaatatcacatttcatagaatattaaaaatatgtaaaattgacactaagtgatttgtattatatatgaaatgtttagtatatgattagtaaagcttcataaacaatgggaaactgatgggtcattcaaaaaatggtataggcagaactgactttttagaaaaaagtaggttataccaatctcagataaaacataaaaaagtagatgaatagctgtttgtattaagaacaatataaaatagaaagaaatgaacacatatagtggtcttaccacacagaaggagtttcaaggtataaaagtcatgaatgagagagcaaatgtcaaacttgacaacataaaaatgtagaaattatacatggaaattttataaaattaaaacacaagtgacaaacttgataatatacttgtaaaatatgacaatgaattaatatcctttataatcaaagaaactgtatgaaacaattactattaccaaccagttgttaccaagagtagaaaaataacaactgagatggttagcagtacacagtaaaagaaattcagagaaatgatggacacaaacatatattaaacttcactagtaatctaagaaatctaatgaaagcaataataaatacattcttgcttatcaagttgacaaatttttttaaatgtaaaaacaattagtgataggaaggtgcacaggcaatctcattcaattccggccaaaatttgaataaattttctagacctgtgttttacagaaagtatttagaaaaaaactaaagttattattctttcattcaataattcttattccagaaaaatttcctaacctaaaaaacatgtaaaaatacattcatcacaatgctccttatgacctaaaaaattggaaacaatttaattgttctgatgtagagaaatagatatagtctatccaaaggatattgtaccatatggtagagctttgagggtggccccacattctgctccctctagattctctctgttccagctccatcctagcttcctcaatttccccagaatgccataacctgccctgtgtataggtgagcagtctgagagcctgaaaagcaaggtgacgtgtccgaagtcataccatctacttggtgtatctgaaaccaaactcaggtcttctggtagcaggaccagaaattgttctaccacataatgcttgcttagaacagtgaatttcaaactctgagtagtggaatctctctctctctctttttttttttttttttttttttttgtgggatgtcacctctaagtatttttgtttttctttttttttttttgagtggcagaatcttatgcacaatttccaataaatgaaagagatcaaagtattatagtactatatagtttttaatgtaaaagtatatttacttacaaagtcaatcagtgagtaacataggaaaatacaaggaaaatttattaagtgtttgtcatatagtagaagtggttaggttgagtgggtaggttggtttttaaaataccaacaacaaaaaaagatgctgttctaaaaacacaaacatttgaaggctgggtgatggatatagttttatatcaacgtcagcacacactgtatttctatatttgggtgtttttttttttttttgtaaaatggggaaaatcttgtttcatatgaataagtagctgaaaatgatgaacatttttaatagtttatatgccaacctgtctcaagatattattcaattaaactgaaacagaagctgaaagaaaagaagtagaaaatttaatatttaaaaaataaatcattaaaaatacccaacaaacattatgttccctaactgccaagggttcaacttggaaagagtcagtaacagggtcctcaggcagtttagatcttgagtgaacactggggaatgttataacattataagatgttcaacttgtcagttgaaatccctcacattatccaaaaagggcatacctcactctctatctcagctagatagtcactttagctttcagtcaaatttatttcattgctgacacattatttaaaattttaagtttgactacaatgtgatcttacattgcaaaactgagcttcttctgtttactacaaaaaatcagcaagacatgcaaactagtgaaatcagttttttgagaactatttcactagatgaaattcagtgaaaacgaatttttgccagtaccttgccacaaaacacccaagggacttcagcatgaaaaaaaaattctgaaatgaatactgcgcatattgtttaaataattcttaaaagacaacaaaaaagcaaaagccctggttgaataacatttacaattagaatgatcttaacgccttgcttgaaagatcttaacagcttatgctctcctatgccacccaaatagcttttcaaaaatagtgtttctgaaaggcactagcctgactattttttccctgatattcattttacacaaactacataattttttttaaaaaatgttttgcccttttgttcgtttgtgtgttgaaaattgtaggtgagaagcagtggatttccctcacccatcgctaggttcatggctgaggccactataatagaagacagattaacaaaagaaaagaatataaattggttatataagttttacatgacactgtagacttctttaggaaatgaagcctgaataatgaggcatgcttctgttttttcttttttttgggggggggggggggaggggggatggagtttcactctgtcgcccaggctgcagtgcagtggcgcaatctcggctcactgcaagctccgcctcctgggttcacgccattctcctgcctcagcctcccgagcagctgggactacaggcacccgccaccacgcccagctaatttttttgtatttttggtagagacagggtttcaccgtgttagccaggatggtctcaatctcctgacctcgtgatctgcccaccttggcctcccaaagtgctgggattacaggcgtgagccaccatgcccggcaaacctctgtattttttatgaaaggcttgaggaagagtgggcggtcacaaggaaatatgattagaggacaaagggtgtggtctaatggtactgaactgcgggtggggggggcttagcaaaacctgtgtgttcacattcttcttggtatctctgtgtctttggctcctataccccgggtatagggagagcacttttcaaagagggtcatatgacctgcttccggtgaagatcagaaaatccctcctaggttttatgacctccttcaggagagaagagcaggggtagagggtggtggtcagaaaggccttcctgtttctactgctttctcaaatgtcacgatgtaccacattttggggtggcatgtcctgaaccccatccaaaccaatctaacgacttctactgtgcggcaagtgcttaataaattttccttatcttttcctgcataaacctactgaacaaagaagaaaaatcagcagtagtgatactctcaaaatgttgactcataaagattccgcataatctttatgaattctttgaattaatgtagctgcttgaattaatgaagtatgttgaattcatgttcttattaaatattcttaggttatagcaccataattctaattgtttcttcaatagcagcctattcatctaacatacttgttagcatatagtttaatgagctttttctggagaaaatgcgtttcttcttcacaaacaatacattttgtcattgcttccatttttttctgtaacatgtatgctaaattaatctgataaccttatttttatgctccctatgctttgttttaaaatcatttaactttatgtctgggttctctattctgtcccattggtctatgtgtctgtttttgtaccagtaccatgttgattggttactgtagccttgtagtatagtttgaagttcaggtagtgtgaggcctccagctttgttctttttttcttaggattacttgggtgactcaggctcttttttgcttctctatgacttttagaatagtttcttttaattctatgaaaaatgatgttggtagtttgataggaatagcattgaatctataaactctttgggcagtatggccattttaatgatattgattcttcctgtccgtgggtatggaatgtttttccatttgtttgtctcttctctgatttctttcggaagcattttataattctcattgaagagatttttcaccttcttagttagctatattcctaggaattttattctttttgtggctattgtaaatgataatacctgaaactataaaaactgtagaagaacacctagaaaataccattctggcattacattggcctcagcaaagaatttatgactaagtccccaaaagcaatgacaacaaaagcaaaaattgacaggtgggacctaattaaactaaagagtttttgcacagcaaaataaactatgaacagagtaaactaacaacctacaaaatgggagaatatattcccaaattatgcacccaacaaaggtctagtacccagaatctgtaaggaacttaaacaacaaacaagaaaccaataatcccattaaaaattgggcatcagtcatgagcagacacttctcaaaagaagacatacatgcagccagcaaatatatgaaaaaatgctcatcatcagtaatcattagagaaatgcaaatcaaaatcaccatgagataccatctcacaccagtcagaatgcccattgttattaaaaagttaaaaaaacaacagatgttggcaaggttgcagagaaaagagagcacttacacactgctggtgggaatgtaaattagtttagctactgtggaaagcaatgtgacagttcttcaaagagctaaaagcagaactaccatttgacccagcaatctcactactgggtatctacacaaaggaaaataaatctttctaccaaaaaggcacatacactcatatgttcattgcaacactattcacaatagcaaagatacagaatcaacctagatgtccatcaatggcagactgaataaagaaaatgtgattatatatatatatatatatttatttatatatatatttatttatatatatatatttatttatatatatatatttatatatatatatttatttatatatatacacacacacacacatacacacacacacccctatatatacatatatacacacacatacacatacatacatatacaccatggaatactacttagccataaaaaggggcaaaatcatgtcctttacagtaacatgaacaaagctaaaggccattatcctaagtgaactaacacagaaacagaaaaccaaataccacatgttctcaattataagtgggagctaaacatttaatatgcatggacacaaagatgggaacaataataaacagtggggactgcttgaagtgggagggtgggagaggcagtgtgggttgaaaaacaacctatcaggtactatgctcactacctgggtaacaggatcattagtacaccaaacctcagcatcatgcaaattacccatgtaacaaacctgcacgtgtaccctctgaacctaaaataaataacagaaagtatagacctactatgcaaaattttcacagcctaaaatacagtaagaactgggttatttttatacctaataacactcaatgcaattaccaagtgctatgtggaaggcccttctgcatgctacttttgttttgcacagtgttggtgtggtaaataacggtgaaagaatccagtatatcaagtcattgtttttgttcaatacatggtaaaattttctttccaagttttcagttttaaaagtgacttgtttctaatttcagagtcttgttacatcatattttttttttacaaaaatgattcaagaatacttaaaacttacaatgagcgtacgggacatgcaaaataaaacaaacaagcgcttattatttcctgtaagagttttatctataactatgctgtctaaacatggtatggagcacttgaaatgtagcttgttagaattgagttttgctataagtataaaatatactgcagatttcaaagacttagtccaaaaaagtaaaatacttcatttttaaattaatgctaaaatgataatatcttagatatcttaggttacatgaaatatgttactaaattaacttcactggggttgtttgttttagttttttcctgttttcttttcctttttataatgcagctactagaaaacttaaaagtacatatgtgacttgctttatatttctaatggacaacactgaaaagaagttagaggccttccctgatttgatactaggaaattccatctgtgtgattgatgcctcaacagatggtgctacgagggcgtttagaagaggcatttgacagaacagtggaggttcatgaaggcctccaggaggaccaggtgataccagagctgtaacctgaagggcagataaggggaagctcctaagagaagtgcaggggctcagaggtaaggaggaataatgggcactagaaagtagctcggtaaacctagagcagtgtgtgactagggagcaagagccagagctgaaggccttgtgtgccagactaggaattctgggttattttgagggaaaagagtagtcaggtgtattagtctgttttcacactgctgataaagacatacccgagactgggcaaattacaaaagaaagaggtttaatgacttacaattccatatggctggggaggcctcacaatcatggtagaaggcaagaaggagcaagtcacctcttacatggatggcagcaggcaaagagagagcttgtgtggggaaactctgccttataaagccatcagatctcatgagacttactatcatgagaacagcacaggaaagacctggccccatgattcagttatctcccactgggtccttcccacaacagaagggaattatgggagctacaaaatgagatttgggtggggacacagagccaaactatatcaccatggaaggttgtggagcagggatgtgactgactcaggcagtagtagatcactctggctgctatgtgacaattagaatggagtgaggcaatactaggaaaagagggtccctggggcagctgtgcagaaatctaagcataggatgagaatgcagtgaggactgagggcccatggtagaataaggaaagccaaatggatttgagaagtagaagtaaaaggactcggcaatgcattcagttgtttggagtttggagggaagtggaggaggcaggcaatgagagaaaggattaaatcaagtgagaccctaggatgctgggttgtgcagctgagctggaaaataagaataatcaacaatgctataaaaattattttcgagatattcagcttccgtatatcttaatggtacatgggtgaccaagactacaatatactttcatgatttgccataagatttctgaggctacttggagttctatgtgtcattgaaagtttgcataatagttcatttttcaaaagtatcttttgccagagccctttgactttattattctgataatcaaaatagtttccttatgaagaagtattcttgccaactaacctaaccacatatttgaaacatcagatgttaataggttggctgatattttatcttttgtgaaatttgccttaccttaaaggttttccactttaaaggtcacaaaagaggtttgctttcctttttagaaagtaaaaaccacatacaggttcaaattcgaagataaagactagtaatgatttcctataactaacacatatgcccaatgagtagttaaagatactcaagaccagatcttgattttaaacctttacatgaatccattccataattttactcctttattcctcaatttcacctaagtgatctctgtaaaataatattctttgattatccaatgcgagtgatagcacatgaattatgtatgatctgtttgtatagatgacattgagaatgttatttaataacaagatcatgtttttgaaaataaaaattacccttgggatttagatgcagaaatgtttcactaacaaagggctctgaaagaatgttggcatcagttaaagtgaaggtatgaatggtggcaggccaagaaaacaactgaatattagtttcttgattccaaaggtttaatattttcatttataataaatgagtaacaatgataaaaattttttcccagaaataaaaacaatggaatatattatgggaagtgttacaagggaatgtctcctctcttaacaacttgaaaataaatgagagatttttcaacatgaagaacataattccacaatgatagcacggtgcacaatacatcattttttggaacattttgaggctttaagactttaggtttaatacccttggcaatatacatgtgtgtacatgtgtatggggaatggtaatctgtgtacaaacatgcacacaaacagaaatgtacattgaactaaaaatctttgtacaatgaggtggcgggagtggggagcaagatttttaaaacttttttgttaccgcgcacacacacacgcgcgcgcacacacacacacacacacacacacacacataggtatatacactattccaaaagcagagccgaatatattaatataaataaagtagacctggattcaggccctaaggacctcgtggcttaatagacaaagaaaaaaatgtaaagtagaaagtggcttaaaaaatttataggaaattcaggaaagaagaatgttaacttaggctcaaaaacaatcaggaaagtgtcataaaagattgccatttcagatataaaaaaatagaaagaatgaatcagccctactatttgatagcacaacagggtgactataatcaataattactcaactatacatttttaaataacttaaagagtgtaattggattgtttgcaactcaatagataaatgcttgaggggatgaatacccctttctcatgatgtgcttatttcacatggcatgccggtatccaaacatttcatacaccccatagatgtatacacctactatttacccacacaaattaaaaataagtttaaaaaaaaatcaccatttcagctagaccttgaataataggaataatctgaacatatggagaaggggaggcaaacattgaagttttaaaaaatggagaaagagatagataaatatatagatgcacacattcatgaaatcgtactattgagccaggagctttcctgatcatatctaaccccaggacaacctgtgaggcagaaagttttcttcacattccagaaacaaggaagcaggttcagaaagtctcctatggtcaccggactgggaagtgccatgcaggagctgttggatccaaagcccacgttctctggctccacttgtttacacttgcttaatgatttggagacatgagcttgtaggacaaagggaagagcaaagcttccctttgattggagagcaagatagcacaatatccaaagtggaaagtcaggtttttccttcttcatctgttttacctgacgagggccagaatttaagggtctattagtcatagatggcatggagtatgcactccctgtgttctgggcgctgtgctgaaaaccttctgtgtgttatctcatttgatctcttaggggctctgtctccatggtttttggtgaaagcacagagggttagaataaggtcatttccaaggtcaaagagctaggatacagtggagttgggattcaaactcactgttactagactccacacaagaacctggggtcctaatcactaaacatagtgcactacaaagcacagttatgtaacatatgtcatatgtatctgtgtataaatatgcatgtatacatatatatgtgtttactttgtgtgtacacacacatacctgcacaagatacaccccttaaaaatttcatacctatcagtgatctccaagtatgcttgtgttgacatgtttgagtttaatacaatttgtttaactagtgatcatgttacttggtgatattttcttcatttggccatgaattaaagagcatttactgggcacctgctttaagccaaacattctgtagacagcaggattcaaagctaagatataactcttgcccttaaataagctggtaggtttaataaaattggtctatatgtgttgcattattttgaaagttatttgctattattgtgttcaatttattttttggtttgctaagaatacatagagataacagttataaattacaaggttaaaaaattcgaataagcaaaaatctcctagtttgctaactatcagttaaatgataatcattgttaaatgatgaatatgtcatattgcaatgtcagtttcacaggcagatttactaggaagctaatgaagtatgatcttcaagatttctcaatttcattgacacattctaagactccattcttatttttgtgaccattcatttgtattccttttcttaagagtcctccctttatattttataaattttaggatctaagaggaccaaatatgcccctggtcagtctttaataatttaaaggcaacccaatgatttgggattgatttcacagtccacaaaaaataaagaactatttctttcctatacctctgttggtactcacctctatttggtatttgcattttagttactccaatagatacccatactagagcgtaagtactaataaaaattaaaactcatgtcaatgattatctctccttataaagaagcctacagagggtcttgaagcaataaagtaatttgaatgaaaactacaaaccatgaataacatgacacctactacttcaaataatccccaagtgacctttatataatttttcttcttggacatttgaaacactttggtagtttaactccttaaccctgtactaatgagatagaatataggtattccctccatttacaggatacgtactctgaccaaggagatttaaaacaaattttatttatttatttaattttggtaatatttgtcagtgaaaaaagctgctgtttaaaatatatatatattcgggcccagtgcagtggctcacgcctgtaatcccagcactttgggaggccaaggcaggcggatcacctgaggtcaggagttcgagaccagtctggccaacgtggtgaaactctgtctctactaaaaaaaatacaaatattagctgggcatggtggtgggtgcctgtaataccagctacttgggaggctgaggcaggagaattgcttgaacccaggaggtggaggttgcagttagctgagattgcaccattgcactccagcctggagacaagagtgaaactctgtctcaaaaaaaaaaatatatatatatatattttttaaatatatatatatatttattatatatatattttaaatatatatatttattatatatatatttaataaataaatatatatatttatttaaataaatatatataaaaatatatataaatatttatttaaatatatatttaaatatatataaatatttatttaaatatatatttaaatatataatatatatttatatataatatatatatttctctatatattttatatagagatgaagtatatatttatatataaataaatatataatatatatttctctatatattttatatagagatgaagtatatatttatatataaataaatatataatatatatttctctatatattttatatagagagagatgaagtatatatttatatataaataaatatatgagacagagaattttatatatatatatttatttatatatatatatatatatatatatattttcatgattcttgctctccaggaaaaacatctttcaaaaacattgaaagatatttcaacactgaaagaatggagaaatctttgccttcaggtttgactccacctaaagcatctgtaatagattcactgcatggcctcagatgctaacttcttagtggagtaatggcatcaaaacttgtaatctgaactaatttaagtataactttattcacatattcttctctttaaggattttcatctcacggattttaattgcagtaataaatggattcagtgtatttttgccccagattatgtactcattctttcagctaagcaatatttattgagaatctatgatgtgatggatattgatcctagtgctggaagcagcaatgaatgaactatacagaaagcctctaccttcaggaagtgagggagaaccttgaagaggtgtctttcaaatattgatcttgccaaagtctgttgtggagtttagtaaactgtaccaaagcagtgtatgactgttagcaaaatacacataatttcattttcacttgcagcttataaaacctgtcagtcatttctccaaaatattggattttctagctctagcttgggatttccattgattgccagtagaatttaaggaaatttcctttctgaggccaaatgcatgtctcagcgctgtccatgtggaaatggtcaatacaatttgaccagtaatagttttttgattgtctatgggaacatctggatctttgacctcacaagtagttaaacaacatgcccttctccctatgcaaaagtgtttgttcgtttgtggctcagaggctctgcgtttgcatgttgggcttcatgttctggaagtcattttctctagcagtgaggttatttaattccaaggactggtttgaatttctttttaaactacaagtgtataggattacatttaattgttggtttatgtacaggagcattgctacactgagctgcaaggagcacattataaagtactcgtttgtcctgagtaaatattcattcagttacaggctggatgagagcccatgcatctctgaatcatgatgtctggagatctggacatcagataggcaaatatctggagatattgctgatattatctattaaccttttgctatctgtagggtcttataaagtagcttgacaattgcagtgtaaatcaggaaaacgaatgcctaaagcttggacacatcgaccagatggctggagtttaacaagtgtgagtacatatttgttggcaacacacagtcagacaaaaaggcgcttgtcctggcagctcacagtgtcgtctgtccaggggcggcagcaacacagactgaggccttgctgcacattgtatcaggctcaggggcaggaacatagggtccttttctgggtcaaatctccctctgaaggtgagagtcaagtcaaggaatgattttcttgaagtgcagcatgctcttccagcagtttctgagagggagatgtccctaaaagggtgaagagagggcatttgttccaggaccctggttcctccaccttccaggatccagaggcctgactgttcatcaccactttcagtgcattctcaacgctcactctctgcatgattcagaaggccacattcttcataatacagtcatgctagacttggaattttgacaagccatgttctcatttctgtgatctatgcttcataaagaccatatggagtatactaaatctaaagaaatctatctgattgtgaacacactgtgtgagacactactaagaagggagtcagagtgaggagggcctctggtggcattttccaacttggctgattgacacaactaaaagtgttagacataattgggagtatgtcattagacactcactaacaaggtggtaccccacttagcagaaccctttttccacctaagggtcctgttcagtgtggtgaggagcgacattggtcagcaaacgtggctgctgcgtgtggtactcatgttacagaaacttcctaaacccttttgggatctctctattgccttgaacagatggcctgtgagctgcggggccttcttccagatccacggcctgcagcatctaggcttgtgcccaatcactaaatggagtcctgcagggcccttcctgatctggcccctgccaacttccccagccttgcgtctctccactctccagttctcctggttatctgaatcccattcccttctagccattcttcatttccttcatttcctcaattgcctttagagttttgcatcaacagtttctcattcttagagcaaacaccctcccagcttatcttgcacctccaaccttcactgaagacttgtttaatactagtttctctctcccctacttaatcagaatacattattcagaaagttttccacaacccatcaggatgtagccagtttggctgatcacctagaagggacccctttttcccaaatctaggttggttcttcccgcttcctcaatgccaaggataagggcacatcagacagagtcactgcctccatcctgccccaatgacctctgctctgtagacctctggtcctgcaggctaacctctgaaggaccagggctctccatcatgggaggagcaaaatcttcccctcataaaaccccatgatttacatggtagaactgtgctttgtatcttgtacacactaccaccaaatgaccctattctgcttctaccttcttccttccgcaaaaccagatacacagcaggccccattatggttttagggtatataagatggtttctcatatattacatttctgtagaggagtgagcattgttactccctgtactctacaatgagttttgaaaggaaaagtcaactctgactaagatcacacagctgttgaggaataggtttgggatttgaaccccgatatactcagttctttccattatgtccaccaatctgttttcttttcttttttgttctatattgcctcctgttttctccaacacaaagtgtctatggacttcaccttttaaaaatgactgtatataagtgaaatgtgtttggctttagttgtttgccttcacagctatctttttgaaaacaaagtgtggctaggtgtaaacccttgggattctgagacaataagtaaaagatgaaatagcattgcaaacttctgacatttttgaactgtgtatcaagatttgtggcatatgtatttgagtctgctacaggaaaattcccagagcacataccacaattattcccaaagtaccttgaactgagatgcctagtcagttcctataactgggtgcaccagagatcgcactgtactccatgccataagccttcacaggtacaggtttttctaaaatggagcttgtgcagaggctatagtcgttttgcacaatgaaagaggctgtcttcaatgtgcatttcgatgtgtgctatgggaatcaggactaaccacgacccatggagacaatgctgcatgacttggagagtgcaacgtaagacgcaatgactctgagcctgcaccacgccatctgacctcaggatctccctgcagggatacgaggagatcttagccatatagcctttctattgccctctactgtctagggataaaatgacagaaaacacagttctgcattttggaagtttgcttaataactaaaaaaataaaaataaaaattactcttgggctgaaagcaggttttccaagttttggttcataataagtagtttttaaacatttaaaaataggggtatgtaataaaatgctgagagactctctggagaccgctgctgctggcactgctctaatagaaagcatacgccattgagctaacattctgttctttgactgaagaagaaaacaaagctgttaaaagctggtaagctcattttccaatagcaatagcattaatatctttcaagtcactcctaaccatacctaattagaggtttataagggatggctcttctggaagggtcacctcaggttacgtagcccacagatttgctgttgattgttggcaacaatggatttgtgtagattttctgctcagctcgaggtgattatcttttttcttttttttcttttgctggtgtgtctcttattttgactggctgaggttgggctggacgatgaggccctgatttgaaagcagtgccaggttgttgctggagatctgcactgacagattgttgaaaacttattagtctctgacgttttaacagcctgcaatgggatagaaatctgctctttcactggaaaagcttaaaaaggaaaacatgagctcgagctgaaatcagccccagttccaaatctgccgtcctctggcaccggagtgctgagggctgccacagtgtgtagagattgaggcctgactatgccacccacatggtagacaggactctgcataaaatgatgtggccctgggccactgtcacgtaggagaccctgaaaatgtatcttctgggagctggggtgttctcaacactgggtgctaatggcttcagcagtaggagaaatcagcctcactgaggtttcagctgggtggctggggggattcttttggtcatagccattctataagataattcaagaaaaaggactaagaaacacttcagcttggtatcctctttggggtaacttctacctcaaatgggcaaaatgatggcagccggtatcactggtgagagacatctggagccaattaagagctctaatacagagatagctatattgtaattatttgatacaatgctagagtaattcattaagcatcctggttcttcgaaagcaaaccaagcctctccagtccagtccataaagatttttttttaaatcactattgaccccaatttttctccaatcccctctgtgacgaccactttgattaagctctctgctttcacccccagcagttttgctcccatccttggcagctgctttcaagatcttaaccaaggttctggactttgcccagacagctacctatgcctagaggagtcctctcttttaccagataactctttcctatgctccagactcaggcctgcggtcatgtctttcaaagccttctccagtaaccccagtcaggggtgggtacccagcattgaaagtgcccatagccttctatgttctgacttcagagtaggctacaaacttcttaaggaaaagacctggcctgaatctcatttcattttgtatccacactcatgatacactgttagcacagagtaggcactcagtaatgtcttgctgactgttcacttattcattcactcacttgatagacattaatggagatccaaacttccaggcactgtcagggagttcagtttcttaacaggagatatctttttatgctctacagacctaaactactttctctccaggcctatcttctagggatctgtctttgattagtaccattcagttcttggttggggaaaagtgtgagatgagaagtgacccagatgtttggaaatgtcatctcaatgtcaggtttcgcccttcatcagcccattgcagctgcacatcatgcagctgcatctatggcagtgcttactggtgtatatgcagaaatgtcctggaaaaataatctcttctcatgctaccccagaaaacttcagaatagcccacagaattacggtaaggaattattcattcattcatttaattaacattgggagcgcccattatgcattagtcattgtcctagacatttagggattcagtggtaagcaaataaaatagatgcaatcccaatagatatatcagcatacaggcatttgccttgtttacctaaaacctcatttgggaaattcatgtattatatggcaaacttgcagattcgaagtaaatagaaaggaagtgagggtgggggtgaaagcagcctgtgcttaagctatgcctactccagattccctttgccactcttgggacggacaagatgtactttactttccactaaacttcaaaaacttccccatagactgatcatggttagcactttttcagctcaagaaacttaggtttgattttttttttccccaaaaaatgactctagtcatatgtcaggggttctttttgttctggttgattttgttttaacatgctatctagcacagtcatggagtgggtgagtttttctgcatttctgcaatagcattcagtgtttagttcccagcttcatgggtatcaagaggcaattgcaccaataaatttctaaaccctggatcactgccacagtgctgtgttcttgaagtcaacaactcagtgatgcttcctagttttccactttcccaattgtggcccactggcctagtaaactcccagcttggtgagtcaatttcacagtgtggttttgagtgtcatttctggaggtctagcctatagcctaatcctccaataatttcataaacatctaattccctttattaaattcctttctgctaaaaaacaattataaatgtgagaagaaaataataaccatagcctattaatttctttctgataacatttaacattacctacttgcagaaaactgttatcttctcagctgacactcaggcaaacctccaagcatcaaggatttctgtctttggttttatttgtttgctaatgtttccactgttctgaagatatcaagacacattctctaaaaagattagttgctggaggtctgctgagagaataataaattcaagttatagtaactactcaggaaaataaaaagatatatgaaagcttatctgaagcagaaaaaacattaactggtttaagaaagctggaagtgctgtcgattgaacaatgagaacaaaaacgtgagcttttcactgtttttaataactcctattgaatgtgatgtgggactattatcagtattttaatattgtcaattggatataatttttctttaaggaaaagaggttcatttaatacttaagggtgattttaaaaatgactcctaacatcaatttttttataactaaacgtatggtgaaagtgatgataaaattcagtttacttaagagaaatatattttgtgcacattttgctagaacatattatttagttcatggaaattatattattttaatttaaaaattgtcttaatgtaaggataggtgcagtaatttttattatgtttaaatggcaaattaaaattatatatatctattgtgtacagcatgatgctttgagatatgtgtacattgtggaatggctaaatcaagctaatcaacatatgccttacctcacatacttaatgttttgtggtgagaatacctaaaatctactctcttagcaatttgcaaatatacaatacattgtcattactatagttgccgtgttgtacaatagatttcctgaacttatccctcctgtgtaaaattttgtaatattttaccaatatttcttcaatttcaccctctaacctcacaacatcccaagctcctggtaaatattgttctaccctctgcttctacaaattcaatttttttgaattcaacatagaagtgagatcatacagtatttgtctttctgtacctggcttatttcatttaacataatgtcctccagattcatccatcttatcacaaaagacaggatttccttcttttttcaagagttaataatattccattgtgtgtgtgtgtgtatctatatcacattttctttagccattcaactgttgatgaacactcagttggccccacgccttggctattgtgaataatagatgcagtattttatagcattcatctttcccttcctgaataaaagtccaattttagatttaatgtggaaaattcttaataaattagcaaccaacttgtgaaatgttgtgacttttaaaattagaagaatttcttcattttcaatcctaaaaactaatatgggaattaaaatagaattttactggatcagttaaatttgttaatttttatttttgttttacaatcttatcgacaataatttaaatcagtacattcttgtgcataatgaagtaaaaactaagcttccaatgatactgtgatgtagattatattaccctgttttacagataagaaggcagatttgcaaaactaaatgcccatgatagtacagtgataagaagaggcagcgacaggatttgaattttgatcagtctgatccaaagcccgtgctctactagatggcaattcttgcaaacagccagtggttagtgggtgagagaaggggataaaagtaaagatagtctatttggccaaggcaatgagcaggtcaaaagtagccaatattcgagaatctatatatctcagtcaaacatccagtaagctgtcaacatttattctatccatcattggagaagagtattccatagtgagtggtactgcctgtgcctcaattttctactctgctaaaagagtacaatgcgagtgtgaaaagtagaggcacagcacttagtacaaggcttagcccataatgtgggcacaaatgttagcaagtccacagatatttagtctacctaatccacaaagatttatgaaggccctggtatgaacaaggcagcaggattacaataatgaggcatgttaggaacactaacaatggacatagtttgactctttatggtctctgagggcaacaatggacattacacacatgaattcatatcctctgtgctgtggaaggagatcatgtgccagcaggatccctctgttgctagcagagatccagccccttggatgagttcttcaataactatgccctattatctgaaggcagtgttggctgggagagatgggcacaaacaaggcaagttggtctcgatatttcaggcacagaagacaagacaaagatagaatccctaaggagagattggatcctgagaattaggcagaatcctggtgagcagcaccaggtacaaagtcagggtcacctggcagcagggtgcttgcatggggactcccagcaagcttgactagagcatagaaggaggagggttgcagcacccgataatccagcagggcacaagacgttcccccaggacagatcctgcagttttctgaaacgtagaccctgtggcttagcccagttaatctcgtaaactgggtcatcaccctgggttgcacagcaagcaggagcctggcagcgaaggctggataaacactggcatcaacaggaaaaagcactagaaagaaactggtttttttcaagccctgagaacaatcagattccctcaggtattgctttcaaatctgttaccatcatcaggtaactttacaaaacagggcaattaaagagctagttaaaggcgcctcagcaatttcccagacctccagggaggtgaagacaaggaagaggaccacctcattgtcattggaagggccaccacacctgttcttgctatttggtgatgagcttgtctagccagtgaacccaggcaggccatgactgttaaggaatgcatgcttcacaggagtttcaaaaactcctcctgaatttgtttatggccaagaaagagagcaagaccccagctcctgtgcccatattcacaccaatgtgcctgttgagtggcacatataaggctgcccttgggctatgatagcaaagagaagttatgcaacctcaacccatcaacccctgcccctagaggccctgcaaggaaagtagaaaagctcttccttcacaacacatgtctggactttttccatagcaaatggcaggggagcaccctagggtcctggagttatttccttgtaggactcagaatgtgaattgatagagcttcctagcactttgttttgcctagaagtttagaacatttaggaaacctctgatccttcatttaaaaatattaacactttcactttaatcactttaaacataatcactttaaaatacaggtaatgcagaaaatgcatcccagtaatttgaaaaggtttaatgtcttccaaaacaacgaaataggaacaaatactatgatcagactccatgggtcgttaatcctcacatttgcttctctgacctgacttggtggcatacattggcatccccatgttacttatgaagaaatgaagcatgaagagattaggtgaaatgataaatatgacacgaggtgagcagagtagctgggaagaaagctcaagatctaggatctccattgagaactcaatgctcttttgcacccttaatctgtatccaacctccttcctccatggtccagcctcttgactcacaaaagcagctttctttcttttcatatcactgaaccaactgtccatctccacataatgtaggccatcttaaaaaaaaatggattgatttgaatgtaacagcatcatcctttctcctctcaacttgcccctctttgtaccagaggatgtcataatcaggtgtgaagaacatgaattctcacatccaggaattttttccccttaaatttctttgtcttatataatgtatagttacaacaaagattgatgggaatggaattaaccaagttgtgaactgtaaaagaaagaggaaaatgagtgaatgtagctcatcttcggtctccttaagggcaaaggaaatatgtagtgagaacaagttattgatgaagacagtccagtctgctaccaaatggcctctcaaggaagacaggtgcagagatgtattgtacaaagggccatttttatattcagagttgtgaatatgaggacaattcttatttcaaaatatttgaaatgaaggaaaacattcagagaataatttaagggacacaccattatagaaaaaattgatagccccagtgtgccctccaacatttcatttctcaacatttcttccccctaccctaaatttgatgcttcattattcattgcatgttttttgctttttctataaattaatgtatccataaataatatgtactattttcagatattttcaacttcataaaatatggacaattgtttttggcttaacattatacttttatgttttaaacattatatatgtcttatatgattggcatattatatattttatattatttgaatattccagatttttaatattatgtatttcatatatacatattatatatatatgttttacagtatatgtagctctaattcattttaactgttgtgtagtattccacttatgaataatacttatttgtctgttttgtaccaagacattaaagttgtatatgaaatttctctacttataaatctagaagacaacttgctatgtcatagggtatgaacatttcatctttgctggattttgcaaataattttctaaagcaattgtatcattttatattccatcccgcaatgtgtgagagtatccatttctctacagtcttgaaaacacttgttattgccagacttctaaattttgtgaaattgatgagttgaaaataaacctcattttatctttaatttgcttgcttctgatcacagctacggttaaatatgttttctatgtttattgaccattcagatttttcctcgtctatgaattgcttgctcatgtactttatccatttttctattagatttgttatgttctcactgatttgaaagatttatgtatacattcaagtactaacgctttgtcaatatactcatcatacaactgtggcctgttcttaaataactgattgtatctctgcaggaatttgccttgcacaaaagttttaacaagcaagttaaaactaagatatagataagaaagttgatatttccgtaagtctgtgagttcaggaaaagcattaggaatgccagtttttcattatttatctacttgtttttccttccaagttcagagagataaagtataggccacctagctttatgtttgatagtatctgtgctttgcagagtgggtagtgtagaataatatgggagatgaataaggaccaattttgagaataattagccgcagattattgggcctaatagattgcatatcttccactgaaatagaaactgtttcaaaccaaatgcatctctagtcgtgacttcacatgggagcacatagaatctgctctatgcaggggcataaggcatgcagaaacaatctattccaacttatccctcaaatattttactaccaggcaagtctctgctcatgacataagtccctagactcaggtaaccaatgaaaacaaaagtagaataatgttatggtaatgtcaggtcacatggatatattgtcttgggaatcttgatatgaaatcttaaaataaccttggctatctttctatttcagaggtgtggcgaaatcttgtttgagaaccccgatcagaatgccaaatgtgtttgcatgctgggtaagaaggcttctcattttaaatatattaagcatgttgatgtcatgtggagttatcattctgttgcctttttggctgtctctcattctgttttgaagaggctgataggttcttttgtggttatgcagacagctataacacatttatatgtgtaacacttgatgatgagaaaaggttctgattttcttaattgtcagccagtcaaggaccatgcttctgagtctttcaaaaattttcttggatcatcagcataacatagaattaggtggtttgtattcaggcagctatgatgaaaaggtaagaaccatgttgtaattcctaaaccaaagatggatgataagatagacaagtaaattattaagtccttacatcacagtacaaaacccttacttagaatttctggaagaaatgtatatttgaactactgtaatctgaagtcagcacaactattatcgacacagcatttgtaacaaaataacaacattgtaatgaataatcatttgttcttgtaggatgatatatcatcaatgcctttgacaaactcttttaatatatactgttaggtaatgaagttggtattattttcctcattttataggttagaaacaattatagagaatataagtgatgcacttaacctcaaagtgagaaatggtccaaatcatgatatgaaagtttctaaacagtaaaattttaggtctagtgtttagatcttatttaagccactaaactatgtccaataaagttgcaattcattatagtaatagaagtaaacagtagcatggataaataaaaataatttctaaattttattttcaccaaatttttacctttgtagattctaaccttgaactatattaataagcaaagaaaaaaattattcattttagcattttctatttactctgcccacttcatatattgacagtctagattattggtgaaaagcagacagcaagttaaatagaggcaggcaaagatcttggtaatttataattcaaaataatcatgtaacaaataatcaaaggtggtacacgacttaagaaacaaacaaaaaccagacatcatatttttctagccttctaatctttcttaaattctttactgatttttaaatctctctttgcagttctatgtttttattttaattaagatggtggctatatagtaatacattcattgaaaaatgaacgttttactagaagcacatgaacgaagaatatagcattgcatccatacacccatttcaaatatccaatattccttccccttgaaagtgtgaaatgaaaatgtctccaaagttctaatatttcaggtactagatagatagatagatagatagatagatagatagatagatagatagatagatagacagacagacagacagacagacagacagacaaaacaggtacagatggaagcagaaaaaaaatcctttgttaagccatgtgtcccagttttggatttgggaaactgttttaccatcacatcaaataatctattcaacaattaactcatttaattttccacaataacaagatgaggttggtgctattgttatcttcattttataaataaggaaattgagggaaatggttgaatactgcaggtaccttactaccactgaaatattatttgattgtagctttcacctggtctagtaacttgaatcaatgtttaactcatgataattttaagcacatgaatgcatcatctattttgactgaatgtttctgtgtcctgtcttccatgtaagttgattgattagtttatagctagaacagtaagagactttctactactgcctatagatttgaattcacttaaagtaagatcaattatctttccatctcttctagattatgtggtatggtttatatagctgccagaaaacaatcctgaccgccaaatatgtctctaatgaatctgccagattgcacaaaattctaaaattagaaatgcatttatataaatcagttttatgttgctaccactgtcataataattacagttaattgagcacttaatatgtggcaggtgaaatccatcccaaacaccttacataattagatcatttattctaagtaaattaagagaagctctatctttcaaaatatagatatctctagcaatagaagagttttaattaagctgatactggttattaaccttgtagatttcattagtttgttagatttccctttttttcgtaattcagaactaaataataaaaggaactgtgagaatggaagtttttattagtttcaggacacataggaataacaagtatacattttacctttaagatagacagtaaataattaatgactattcaaagataatattatgcttagtgagtttgagttgctcacatagtgaaaattgtgcccttgaggagcttatatttaagacggcttagattttttaagagaattgctgcaacttttaattcagacacttatgaagtcctttgaaatcttagatggaagaataccaaaataaaatcattatggatatcaatacacatggatcaaccccaccattaacatgcatccacctgaagcccaaggactgccacttcacagcaaaatgatcctagatgataaaagaaagaagtaaagtttaatggtttattcacttaaaataaacaagagaaatcaaattatgagcacgtaagtccctaaaactgagaccacatcttgtatttcttcaagaaagaatatctatattaacacaaaaagcacctcttcaccactgtctaaggtattaattagtttgttgctatcttcaaaaggaatctcagataatgttcttatgatttcctaaagcattttttgagaaaactttacatctcacacaagaaagtataaggagtctctgatattgtaaaggactattgtgttttataagccctgccaaccataaatgtagtttttatttttgtaggtaattttataacatttttatgaataaatcaaaatttctaaatgagaaaaccaaatatatggggccacctcaatattcagatccctgatggggaccaacctgagacatcctcatctttaactggtcaagcccttggctcactcccctggaaacctccctctctacccactcacactccaggtttgggtgcctgctggatcctagctgtgtactggtttcagcacagttggggtggaatctggagaagggtcactagccagggactccatttgcatttccttctcttccattggcgagtccccatatcattctgaaaagtactgtttttatgctttgtgttgtctacctcacgacttccatgaatatgccattcttatggaaaattacacttctgactcattccgttaaatgagacataagtgtaaaattcacctcgagttactctggtgcgccggattcaatgcagctttaaatggaaccaaactactgtcatgtatgagtcttgcagggaattatttctggcttcaagagaatagctcatgttggatatgaaggtaaatacaggtgtactgcagagctgactacacggagtgttaactatttattccttacaattgttcagagagagcaaatgtggatgatcaagttaaacaccaaattgtaatatatgttgctttcttttttccttcaggcttagggaaatgtgtgtagagcttctgcctccctgtcctcccctctccaccttcctttttataaatttagccataagatttcactcaagttcaaattggcctcagaagtttatataattatatcaatggatatacaactgtatagcaacacttttaccttcttcaggtctcatgaacagatactaaaagaaagaggaagtggaagagacattatctctcactgtataattaatgcatgaagtatggcaagttacaaaacagagtttacttttcaaaagcataatgaaaactgttgggcaaaaagagcccagaatatttaaagaaattatgtaaaatgatcaatgttgattcacttctcagttcatttgtgaaccttgctctgtgaaacgataaatcatgggaaaagaaactttcaagaagaaattgctgatcagatttagtgcttctttgtatctcctatttttcttattattagaatgggattttttcaaattataagccttaatttttaatttatgatattttgttggctcaatttctccatcctctttatcaaggtttaatttttttaatttgaaattttcattggccctgtttttgtctcatgtatgatttctttcatgctgatgagtatcatgactattagaatgtacaataagcactttcttacctgccataacttagaagggagtattcatattagtcagttttctggttgaaaattattataaatgatttaaatgattgctaatcttcagaacaacagaacaccagaaaatcaatattttattaacactcaacataggcatagagggacttgctttgtagcactagctctgaaaaaattaactgtgtactcacagaagttgcttcatctctctaggattcaattcatagttttcctgcaaagtggaaataaaaacatctgtccttcctagcccaggggtttttctggtgagagaatgagatgttctatgaggagaagcctgttatgatgtctgccctaaatattgtgtatgcatcaataagttgatgcataaatgataaataattgaaaatgtaaaaattgataataagcaaatataaataagctaataaaaattattactgatgataccaatggtgtttagaaaagcaatcgaaaagctaaaacatatgaatataaggacaattttttaaatattaaatacattcttcaaaattgcatggtgcctccagggtagaacgagaccttcatctaattttaattaatcggatgtgcatcaagcacctacaaggtcgtgtgcttagcattgagaatccaaagaccagtggggcatagagtctgcccttagagggtttattgttcagcaagagattgaggtcctgaagcccaatgtatgcaacaccaactcgactgataaaggctacagaagaaataaagataaactacactggacttcaaaacatggatagagtgcatatagcagggatgtgaagactcatctatctagatatgaaagttgagaacgtggcagcactctagatggatgcaagaccactctcaaaagctcagagataaactggggagtgtttctggggcagtgtttcaggccacgaggtagatgaaagaataaattgaaaagaaacttgagacctgattacagagagctttactgtcatcattggccctaaaaaggacagaagtaccagataaaagagagttctggtctcttttatttagttagagagtcttttcgatttagttatagcatatcagagaatactctataagctcctaggtactgggtagtattaagtacagccattcatcagctacttgtgaaattaaataattttaaaccaatgcatatttaacccaatgcgtatctgacgacctgaattctggtttgattttttttaaaaacatgttaattctatttttcctcttcatatcaaatattatagtattttattaagcaacaagataatattttcatctgtgacagtagagaaaaatgtttttttcacttttttggaactttgtcagctaataaagttgggagttattttatatctatattttgctcttatcacttgcttcagcttttggtttttgcatgtggacacttatgagacctatatactgtttcttaaaaaaataatacacaatctgttttaaggcaaaataagatttggtatcaaagtaggccactgtggtgttggtagaaagaacagggcattgaaagacctggtaccagctaataactgtgtgagcagaggcatgtcatttaggggttgtagacctgtttactcttctctaaaactgaataataagcaataataacaatattattgtctaccttattagggctgttgaggattacgtgacaataaatattaaaacattcagtgaacttttagaagtactataaatataagttattatttttattaatactcaattttttctaagtccttgcacttcattttatattagtagtatttttatagcaaactgacagtattgtagattttaaatattaaatgatctcaatttggttcaagtgaatagatattttcaagtgcatgttggcaatttagtaatgaacatccttataggttatgaaagaaatattattgtaaagattattttgcgtgcacttgacttaacaagtaaagactgtgttgaaagacagacgttttcaagttgctcgattttgatttattaaggttagaatgcctcaggaatttgaattaattttaacttacactttcaaagctcttcattgctgtcacttggattcatcaattcactctctctatatgcgtgctcagacaacaaaattgctgaatgatattttcttactctgcccaaagagggtaaattgaacctggatattctcaagggaggatggtggaagcatcattccccatcactcacccaaggccctgtcttgtttcacttttcattgcacttatcactaaaggacatattttctatttgtccatcgctgttccccagccttgccctgcaacacacccatacacgcagaatgtgattatcacagaagtaaggactccgtttcattcactgttgagtatccagcatctggaacatctagctgcccagcccctaagaggaactcactatttgctgaatggatacgtgctgatgtgtttgtgagaacagcagtcatccggagtgcatctctcgagtgtgtcaaagatcggttggcctagtatttaaaactctctgctaacatagccaaggccaagggtcagctcctacattaactaactggtggcttcccaagcacactactccaggttacaagataagaaaaagtggttcccttcaaataggcaatgaggaactatcctaagaggaagattaacatgcattcattgagcactgctgtatgcccaaccctctgctaggagtactctgaaagttgatataataatgagcaaggtagaatccctattgccacagagtatattcttgggcagatggagcattgtgctgagaatacaggaagaggcccattattttgtcttctgtttatgggaatatacagaaaattttttcaccttgagggttatggtttaaaaggcattccacattatcctactgccttttaaaattttggaagtcaatattgctttgtgtaagaaaaacaagtttcctagcttgaaggttgctttctgtggaaggttgcagcatttccacagcaacagaacacctcatttttgaatgcagctggaagccagggctcagatgagagctacctgcagaataacaacacaagcgaagtccaaactatcagaactgaagttgtcaagcccaaaagtgatagaagtgtcagtcttgtattgagttagcttcattttctgtctaaagctagaaaaagggaattcaatgagacctatcagccttacacaaagctacacttcagaaaacatgttcaatcaacaaacacttcatagatacacattgtgtgccagagtagggatgcaaagatattgaaattctatcctcagcaagctcccaatctagtgacacagggacgaccacacaaacaatgacaacatagcatgataaaccacaatcaggagagcccaggtcttacgggaaggggaaggggaagggtggagtggcatcaggaaagaccttgtgcaagacatggtaaggagctgagtgtcaaagagaagctccagacagccctggagcttgcactgaggacagcccattgggaaaggtgttgttggtatttctaagagcaacaggtaccggcagcttaatgtgaccaattaaaaactgtaagaaagtctttatgcctggaaaatagagtaagaggaatgagataagacaatcgaatgtggacaggaaggcaggagagattatgaagagccttataataggacaaataaccattgaaagatgtttaagcagaggagctacaaggggagatacacactttagacagatcatctgtttagagtggagaatgcacaggaggaggatatcgctgaagaaagactagtttagggaacagtggtatctatcaggtgagaaaggatgagtcctacctgaattgagacagtgtcagagagaacagaaggtgcaaaatacaggaaacttttcaagagggtgatagaactctacaatgggttgagtgtatgaagtgttattaaacagatcgagatactgccctgtcccgcaaagaagagtccaagagaattgaatttgcatggggtggggagaagttaaattttagacacagtaaatctgagatgcccaaggaactttccactgcagcacagctcagaaggagggctctgcaagtcagtggcggtggcgacataacagaaatgagatcacccagggaaaggtgaggagtgagatgaggttgtgctttggaatgcccagaagcatccccaaaagggttgggcaggttcaaaaggagcctatggaagcctaactaggtaggagactaaaatagagtgggcagaaagataaaggaaaaggagaggattgtaccttagccatcttagcctaactaggtaggagactaaaatagagtgggcagaaagataaaggaaaaggagagaatggtatcttagccaccttagccaagaggagagagtttcaaaaggtggggcataatacaaatgtaaaatactgtagaggtcaaatgagataaagcctaaaaagtgttgcttggacttagcaacctgaaggtaacaacagcaagagcatcagcagcagaaggtggggtgaggtgggtagtgtggagccaggccacagggagctgagggcactcctctgtcaagaaattggtctgagagggctgagtgcagtggctcatgcctgtaatctcagcactttgggaggccaaggcaggcagatcacttgagcccaagaattcaaaaccagcctgggaaacatagcaagactccatctctacaaaaaatacaaaacttagccttgaggtgatggcaggtgcctatagtctcagctactcaggaggctgaggtgggaagatccattgagcccaggaggtcaaggctgcagtgaaccatgatggcaccactgcacactccagtctgggtgacagagcaagaccctctcaaaaagaaaagaaaagaaagacagaaagagcaagagagaaaggaaagaaagagaaaggaagaaagaaagaaagaagaaaagaaagaaagcaaagaaataaagacggaaggaaggaaggaaaggaaggaaggaacgaaaagaaaagtcagaaaggctggtggaggatatgacagtacctctcaaagtctgccgtcaggaagggtttcttaggataggaaggatttgagaatgttttgatggtgagaggaaagaggagaagaactggctgaagttttatgaagagaaatggagtagttgtgagccttaaacctgcgattgtgagaagatggtccccgtgggcgaggaagcatggagatagagacaggtgtgcctgggtccggccaggcagagctggaagagtttccatctgattgcttcccttctttttaagaaggaaatatggtgttctgatgagcttaaggagaggagcaggtgaatgcaagcatacagaactaggttaattcaaaactaatgttacaagaaatataaaaaaactgaatagaggtgtttaaaaaaatgtggagcagttttgaggacccagctgagttggacactgtaaatatccaggcctattctttaaaattaaaaaatacagaaaagacaaactatgtgttcttaacactcatttcaaaagagtaactgtcccatgctcataaagacccttccctttattctccttaactgcttcccggtcctttccctatggccagccaaggtaatctgcaaggggatgccttgaacccaattcacaaatccctctccctggtattgtacatgtgaagttgcttctccacttccccagtgagcctgcacattccgggtaataggtctctgatttaattttctagcaccctgtgttggcctagaattccaagaaaacacaaaaaataattcctgatgaaggtagacaaaatgtctaaggttatatattcacccctaacattctcccaccacccatggtgactctagaaggttattttttgacctgtcttggcctaaaaggggatgcctctacatccacctcccactttgtgaaggagaccaaaggtgctaagccatttgagctctgggagtacaaatgtcccctgagctgggcccacccctgtccaatcacatcaaaactgcctcttccagccagaacagtggttcacgcctataatcccagcactttgggaggccgaggtgggcggataccctgagctcaggagttcaagaccagcctggccaacatggcaaaaccccatctctactaaaatacaaaaaactagccaggtgtggtggcacgtgcctgtaatcccagctactcaggaggttgagacacgaaaatcacttgagcccaggagacagaggttgcagtgagcctagatcgcgccactgcactccagcctgggtgacagagcaagactctgtctcaataagagttaagaaaactgcctcttcctcatcctctctaattctggttcattttccgcttctataaattggattcaaaacttcttgctttcaagatgagtccatctaggaatctttgtatacatcaaactgtactttttaaaatgttccagagacaatgtcatttttaattttgaccccaaaacaatgttaggctttctattggaaggagtatagattatagttatatttcattgtaaattcatattttttaaacaaattattaatataggtttatgagatctcaacctgccaatctcaaaccacctcataaatatatgaggttttctaatattcataaattataaatattcacaaaatatagaaattttcagaatgagacaaattacgtgtattacaaaggatgcacaagaacaaatgttgaagtattaaataaataaatacttgttctcattatatcaattgctatctttgaactgtagcatttctttttcatatctaattgccaaaatatattttgttttcttaccaggagatccattctaaagaagtagctagctgatggtatagaaagctcagttttcataaacccaacattttcccctctcactgaataatgcatgtttttgtgactctagcatgaacgctatcaagcttactgattatttcttactataaaaaccttaaaggcaaatctaaggatatttacaaatgaaaaccaaatgtgtagaatttttttgcctacttcaaggtacccaaccacataggagcctaatttgatttgtagtcaacattttttacattttctgacttgtaatttaaggagatagttaacatgaaatcttgtacattgccattttagctttacctaaattctgggattctgggagctctagttctttgtgacacaatagaaaaattgaagacatcattctaaacaaggacctgacattctgaaatataagaaaatagtgccagaaatgctaataggatatagaattccatgaagttggtgaatagcaccatcctcattttttcaatgataatcatatactacaaatctgagagtttgggaatatgaatagtaaatataagaaaagagttactatgtcaagctgctttctaaaatttatgtcgaaatgtaaatttcagaaaaaggcattttaatattttctcttcttttagaaaatcaagtatttaaaaaagaaattgaacatcttggaagtatatattgaactcaaaaatacattttccttgtttctgaggaaaaaaattagcatcatattcctgaattactgcattgtttatagaatgggtttgttaataattaattacaccaggcagtctacggaaaggtaccttattttgtctgctatttcactctttgtgtcaggaaaaatcttccctcatgaatcatgtttacaagatggttgactaatgaaatgccaagaggactctgggtaacagtatatgaatgactatgatcatgttttgtataatttaacagacatttggaatatcacagagtcttttcttaaaaaaaaaaagtttacatttttggaggcagagtctcagtttgttacccaggctgaagtgcagtggtgtgatcagagctcgctgcctcctggaattcctgggcttaagcaatcctttcacctgaccctctcaagtacctgggactacaggtgtgcaccaccacccctggctaatttttaaattttttgtacagatggggtttcaccatcttgcccaggttggtctttaactcctgggctcaagtgattctctcaccttgaccttcataacagagtcttaagcaaatctctgaatatctgaaggggcttagttctttcaaatattgctttcatgggactttaaggttgcagttcaagtaagaggtagatgataacttcttctcccagactggtctacttcctaggattctagaattttgacggacaggtctccaacatgtgaccatacaaatttgtgtaaatttctaggacataacaataaataaaggattttttcccttgtagcaactgtaccattgaaaatggagaagtgtttgactaataacaaaacatgtgactgccatgtttattttgtttactttcctatggaaaagtttcttagaagatcagtttcaaatgttagcatctttaagagagaaaattttcaattactgtatttaacattagtaagtatgaaccaacaatgtgcatacacatgtgtaagcttatatttaccagtagcctgatgtgcctcaacaattgaaatggtagtttatatacttactggcacctctaattctcctgctattcatttatttagctattggtttattttgatttaaagtggggtttttaactttttaattgaaatacagcttaaattctgagaaatgtctagtttttaagtgcagctcaatgaatttttacaaagttaacgtatctgtacaaaaccacatggatgaaaacagatagtttccctcgtaccgcctcctagacattacctcccaaagattccattctgatgcactgaattctatcaccattccctaattttgaaatttatatagatgaaattaaagagtatattctttgtccagtctgccttctttcactcaacactgtctatgagattcatgcatgctgttgcatatagatgtagttcattcttatttgtttcttttgctatagaacagaagtcagcaagtcacagctcttgggctaaacctgacctgtcacctgtttgattagaacacagccatgtccattcatttacatattgcctatggcagttttcatgctacaaaatggtagagtttggtcatgatagagaccatctgatccccaatacctaacatatttgctatgtgtcccttcacagaaagagattgccgattaccactatagtgtctaaatattcttatacatgtctttttgtgcaaaaaattacacacattctttcaagtatctacctataattgcaaattgcaattgttgggtcatagagtgtatatgtgtgtgtgtgtgtgtgtgtgtgtatgtgtgtgtgtgtgtgtgtgtgtgtgtgtgtgtagttcagctttattctgccaaaaagttttccaaactggctataccaatttatcctcctaccagctgtgtacaaaagtcccacaaataatttaacactcaatgattaacttaagtaaaagttagaatgcataattcatcatttgactcaataaaaacagtttatgtaatagcctgtaatgaagatcatgattatcatttaagtaaacaaatcatcaggtgttaccatcaggttgatgatggtagtaataaaatgagtaaattttatttgctgattatccatgagcattaaagagttgatgaagtttgttgcataaactgaattaatagttattctttgttgaacacttgaaaataaatgtcccacaaatgatcctagtaagtgcttactcacccacagggaactataaacaaaaccctggttcataaataaaaactgttttctgtcgacctaattaattttcattttttctttctcaacaaaatatacaactaactatattttacagatctaaagttataatatgaaaagttatgattaagggagtgagggctgaataggaggaacacagaagatgtgtatggcagttaaaatattctgtatgatactgtaatggtagatacatttgtctatagaacatgcaacatcaagagtgaactgtgatgtaaactgtggatttgggatgataatgatgtgtcaatgaaggttcatcaattataacaaatggaccactctgatgggggaggttgacaatgggaaagtttgtgatgtgtggtatgtggggtatatgggaaattgctttaccttcctctcaattttgccctaaaaaaaccaaagacttaaaagacttaaaaaataatagttaaggcatcatatttggaaaaatcgatagtttagtcctttactatgaaatcatatagcctaacacttctaaacttaaccttcatgtgttgttttcatggactttatacatacttgctctaggaatgaaacagcagtgttttcaattggccttttttatcagtttctctcagtattgggtatgtgcaggtggggagggtcacctttagctagtatcagaattgagttgaatgcgagaattataaatttcgtataaaaaaattcaagaagcgtttttgctaccaggtggtaaaatcatgcatattttttatttccctttttttgtctctttatattttccaagtgttcaataaaatgtggtcattcatttttctaataaaagagattttaggttatttctctgatttctaagagtacaaagggtgtttcttattgtttgtttgcattactaaaacctacatctcccaagtataaaggttttgataactgactcccatggtggaatatgcataaatagagaggtggttgtgacttcaactgtgccttaaggtaaccactacaccagttgctgcatcttagagttgagtcagggcttttattaaacctctctcacaaagtcacctgaccccaaacaaatggaattcctgagatcagccatccttttgcagagggcatgtgacccaaaaatccagtaccttgtatcatagatcaacatgccacccattgacatccagcccatgacatagcacagaagttgcaaaacaataggaaagtcaagtaactgaggtttgtggttctgcggcaaatggaagccttccagaaccaacacactaagagtctgttgcagtagggatgggtgagagctcattgcacaaatgatatcaagtaatgtggaacaaaacactgtggaactttctgaggttctcaaaatcgaaacatgtaacacagccacactagtacacatgcatgcacgtgcacatatacacatggagacacagcctgcctctgcctcagagacatcctcaagatgttatcaatacatgtttcaattatgccaggggaatttgcagttttcattaagctaagagacaaacaaaaggcaattgcacatttccaagttcaagatctctattttcttcctttcttctcaaattggacccaaaaggcatagttttgtctgagggaataaaggtacagttattttgtgcaaccagttagtttactttcactgttcagagaagaaacggagagaaatgctatataactctgagtgtcctaatgtctgcctcaaatatatgaagatcctgctgatacaaaactctataaagaactacaaatacagtgtgattttccaaagatgaatggttatgtatatgtgcatgtgtgtatagaaccttaagtggtaagaaaaattttaatttgatttgattcgtcgtattttgtcctgcattttacagcttttctaccatcaacatgtattactttcataatagaaaaaataaacatgagaaagaaataacctgttggtaactttttttaaaaaaacatggaaaggaaaggtgattggcaatctcatccttagaacacttccctcctcggggaattctttttatacttgatttgtctttagagtgacttttttctatttttaatgaagggggctacctctgcttctgttttttctctaaaaggggataaaaagaaatgggggaaaaagctgagagcagtgtgcagctgaggtccagtgagctctaaagaggccctgaaaggttgttcagggacagcatcctgttgtagaactttcccgaggacaaagagacaggcaagtctttgttcaggctctatcatctagttcattgttctctcattgaaaaattaaaatgtgttgtgaccacttgtttttaacataaaaagctttttctgggttttttttttcttttattttttttgagacggagtcttgctctgttgcccaagctggagtcagtggtgcaatctcggctcattgcgacctccgccacgagggttcaagtgagtctcctgcctcagcctcctgagtagctgggactacaggtgcacaccaccacacccggctaatttttatattttcagtagagacaggcgtttcaccatattggccaggctggtctcgaactcctgacctcaggtgatctgcctgcctcagcctcctgaagtgctgggattagaggcataagccaccatgcccgtccctctgggttcatttttaaagtaaatcatcatactggagggaaaatcagtggcttcccaaaagtatatagtgtctttaattgtacccataatcattgtgactccaaagagcagtgtcaagtaacagtcatatactaggatttctaatgtacaattataaagtaatgataaggaaaaagttgatttgtataatattttgcttatactctgagcctggataatctagagcgtatataatattctatagctatatgatctgataatgatggatttgtccagtaaaagtagataatgagttccaaccaaataggtgcactcttctaggcaccagaaaaacagtagtgaataaaacagacaaaacttctgtcccaggagcttagattctagtaggatgtgggggtgcagtaaatggacagtaaacagtataaaaaattaaattagatattgcaggctgggtgcagtggcacagtggctcatgcctgtaatcccagcactttgggagcctgaggtgggtggatcacctgagctcaggagtttgagaccagcctggccaacatggcaaaaccccatctctactaaaaatgcaaaattagctgggtgtggtggcgtgcgcctataatcccagctacttgggaggctgaggcaggagaatcacttgaacctgggaggtggaggttgcagtgagctgatattttgcagttgcactccagcctgggcaaaaagagtaaaactccatctcataaataaataaatgaataaatgaataagacattgcattgttttagaacatgatggactataaaataaataaagcagaagtatctgtgagaaatggagtaacagtggtagaggcggaggtgagggtgctgatttgagaaggtgaacaaggatctgcttgttcaggagcagcaggatctgctcaggatctgcagcaactgtcctaggtagaaggcacagcacctgccaaaggcctggagcaggagtgagcctggagaacccaaggaacagaaaggaacaagtgtggctaaagctgagtatgttaatctgttctcaagctgctgataaagacatacccaagactgggtaatttataaagaaaaagaggtttgatgggcccacagttccacatggctggggaggcctcacaatcatggcagaaggcaaaaggcacatcttacatggtagcaggcaagagagaacttgtgcagggaaactcccctttataaaaccatcagatcttatgagacttattcactattatgagaacagcatgggaaccgaacctcatgattcggttacctcccactgggtccctcccatgacacatgggaattgtgggagctacagttcaaaatgagatttgagtgaagacacagccaaaccatatcaccaaggaatgaggattaggagacaagaggtcatgggaggcagaattgaggagtcctcatgaggactgtagatttattctgcatgagatgaggagccagaggaaatttttgaacactagtgtcatggaatctgacttcctttttaaaatactggatatcttaggttgattttgaaaattaacaaaataaggaaaaagtgcctgcagtatattgccattgtccttaaacaagcactgaaaggatatgtttagggtaataacaataaagagatttaaagccatatgttatatatgctccagataagtaatatggtaattaatgttcatctaacatagaaagttcaactagagaacataccactttaaaggagttaggacttagaaaggaaaagtgattggcaatctcgtccttagaaaactcccctccttggggaattcttgccgtacttgatttgtctttagagtggcttttttctagttttaatgaagggggctacctccgcttctgtttttctctctttgactctctacctttcttaaagaatagcttggtatcatagttaatggcttactcaggaaactagttttactaaaaaacaaaggaaagagaagcctctcctttttccatgatctttaaggtaggtgtttacaaatgctagcagagttaagcaggctccagagtctctttatgacagagcagggactctgcattctcagaaagttgtctactgacaacattagtggtgccattgacctaggctagaatgagtagcgctccctagggttgcgatgtggcagccctgggcatgagagattggttcatcacagacatcaggctttggcctctctgatgccctttttgtctgagaaccatggactgacccaaataccctctctttgatttattcagtcagaaagtgagaataccagcatttctctactcccatcccctttaattttacctccaaggaaaaatttgtgtgaatttttaaagaaaggcacatctatacagaatttataaggtaactcggtgaaaaggagacccaaaacacaaaatataattgtccactcagtttggccagcaattattgagcatctactgtaatcctagaactatgcttggtagtaaggataggaagaaatgagtgtggccccatctcccgtgttctgttttctagcattatacagtcagccccctctgctctgcaagagaatgaaacaggactggccctttccctgcagtggcattgttttacaaactcatggatattcaggtacacacatcagcctggaacctgggcctcctctatgagttgtttcatgcttatcctggtcaaagcattgataggcccagaaaagtctataatgggtagattcaattgacagtctggagacttgattttatgtcctggctccttccccagattgtacaccataatctctctctgtctcaaattccccatccttcaaacatgtccaacaacccgctatgtaaccccaactttaactgcattgcttatgagtttgaatgaaataacaatatgagtaaaggacacaggaaaaaaaatcaactgtctatgccaatatcaggcttgtaaagggtatggtcactttctatcaagaaaccttggtagttgagtgaaccacatttttctttagtgtgcctttagtgaaaaatgactaattgaatagaattgctagcaccagaacttcagctttcaaaatactaagctatcgctgtgaaggagacagtcctgaaatctgtgaccttggatcaggcacaacaacctatctgctctcaggcaccaaaagcagacttgccaagcaaatattcctggagtcaatttcctgatgaattctttagggtctatgtccataactgtccttcataagaatgagggatgcttaattttgtaggatactaaatggtttggcttatctgctttctccaaaatacatgctgaaactgtaggaaagctcatggccgaatgaatactcgtataaggagaagactaaagaggtcatgggcaagagcacataatagatatccacaaggggccagcgccacttgggcaggacctgaaggccaaccaagactgtgaatccccaagccaaggtagctgagaacagagaaagtcaatgactcctgtagaagcattctcttcatctctttggaagccttggcaagggtactgtggctattgaagaaaggtttgctttttggcaacactgaaacagatttaaattcatattgaaacaaatgacgcaagcatctctagttaaaatagctttgttgggagaactggctagccatatgcagaaaattcaaactgaaccccttccttataccttatgcaaaaattaactcaagatagattaaagacttaaatgtaaaactgaaaatgataaaaaccctagaagaaagtctaggcaataccattcaggacataggcacgggcaaagatttcatgatgaaaatgtcaaaagcaattgcaacagaagcaaaaattgaccaatgggacctaattaaatgaaagagcttctccacagcaaagaaactatcatcagagtgaacaggcaacctacagaatgagagaaaatttttgcaatctatccatctgacaattctaacatctagaatctacaaggaacttaaacaaatttgcaagaaaaaaaattaagaaagtgggcaaatgacatgaacagacacttctcaaaagaagatatttatgcagccaacaaacaaatgaaaaatagcttgacatcactgatcattatagtaatgcaaatcaaaaccacaatgagctaccatctcagaacagcgattattaaaaagtcaggaaacaacagatgctggtgaggctgtggagaaataggaatgtatttacactgttggtgggaatgtaaattagttcagccattgaggaagacagtgtggtgattcctcaaagacctagaaccagaaataccatatttgacccagcaatcccattactgggtatataaccaaaagaatataaatcattctattataaaaacacatgcacacataaattcattgcagcaccattcacaatagcaaagatgaaatcaacccaaatgtcaatcaatgatagccaggataaagaaaatgtggtacatatacaccatggaatactatgcagccataaaacggaatgagatcatgtcctttgcagggacatggatggagctgggagccattatacccagcaaactaatgcaggaacagaaaaccaaacactgaatgttctcacttataaatggcagctgaacaatgagaatacatggacacatcgaggggaacaacacacattggggcctgtggtggatggtgtggagtgggggtgttgggtggaagggagatcatcaggataaacagctaatgtatgctggacttaatacctaaatgatgggttgataggtgcagcaaaccaccatggtacacgtttacctatgtaacaaacctgcacatcctgcacctgtatcctggaacttaaaataaataaaaatttaaaaaataataaaatagctttgtaatatacatttcacatattaaaatatgcatttttctagggatagctttgaaagaaacttctctataatgaggaatgaatcagagcttgttagcatgaaatcatatttcagggtcttccttggctcattagagagcaaaaggtctcatagatcaagagaaaaaaacaagcaaaggggagaggattccctatttattaatggtgctgggagaactggctagccatatacagaaaactgaaactggaccccttccttacaacttatacaaaaattaactcaaggtgggttaaggacttaaatgtaaatcccaaaactataaaaaccctagaagagaatctaggcaataccattcaggacataggtacaggcaaagatttcatgatgaaaacatcaaaagccaaaattgacaaatgggacctaattaaagagcttctgcacagcaaaagaaactatcatcagcgtctgagtcatttttaatgtactgtataatggaaaaggaccccatggctattcagagatgaaggaaggaaatgagatgataggaaagagaaaataacccaggtggggaaatgatgaagatggtgttgaactagtgaagtgccatgctatagccaacagttgacaagagtgttttactagagaaaatagtgactgagtcagtgcaaaaaaagtgacctttctcatatcaaaaatccagcaatttattgtttctgtaaatatttattgagtatctagtacgtgccagccattcttctttacctgcgtggaaatagcagtgatgaaaataaacaaaatcccttgggtctcataaagtttacacttcattggtagagataaataaagtcaggcaaacacatacttaaatcatttcaggtcgtgatacagactatggagaaaagaaaagcaggataaggggacagggagtgacatggtggtggcaggtgggtagcttttgtggagaggctggtctaagaaggcattccaggcagagagggcaacaggtggaacaagaggaaggccagagtgtggaatgggatgaacaagaggagaagcagtaggaggagatgagttcaaagaccccagtggggcaaaattatgtggggtctaggccagtgcttctgaaactttaacatgcatgcaaatcacctgggcatattgctaaaatgctgattttgattcaggaagtcgaaatggggcctaagattaggtctatttaacaagttcccactgatgctgataatgccagtccccggtatacattgtgaagagccagttcctaatccataatggagagtttagatttcattctattatatgtgcagtgttctgaacaaggagtggcataacttatatttttagagatcacatttgcttttgtatggaaaatagattctacgtgggcactgggaaagaactacgacattcgtcagggctggaaattagtggtttggcctagggagactgtagtggggcagcgagacgtttggatccaggcaatattttgaaggtagagctgataatatttgccaatgaattggaggtagtaaacagaagaaaagagggaagcgtgcatccttggcttaagcaactgaataatggtgatgtcatcagctgagatgggaagaggagggtaagggatagtggatggcatggcagcagagcaggtgggggtatggattgagttgtgtcctgccaagattcccattctgaagtcctattcccccgtacctcagaatgtgatcttttctagagctagccgtctttacagaggtaatcaagttaaagtgagataattagaatggaccctaatgcagtatgactgatatccttataaacaggggaaatttggatacacagacacacatatagacatcttcacgcaaacatgaaggcagtcatcgacaagccaaagagaaaggcctgaaacagatgcttctctgaaggaaccctcagaaggaaccaaccctaccaatatcttgatcttagacttctagccttcccgaactgtgagaaaataaatgtatgttgtttaagccacttagtttatggtgctttgttacagcagccctagcgtcctaatatagtagcgggaaagagagattgctcttttaggcagaccccgtcagagaaggagtcaattttaatgatcaggggaaggagctttccagaaagagagagcagcatgtgagcatgtgtgaaagctgtgatataggaacagatggtgtagaataaaaattttattttgaacccaaaaagtagtgacattactgaattggagtgttaaaataaaaaattcattggactagaattcaaaagacattggtatgagttctaactctgccacttactcattgcatatggttaagcaagtgtcttaaactctttgaccctcagtttcctcactggagataaactacccacggcacctatccaccaggctgctgtgaagtccagataaaatagaaatacatgtgaaagtaccttacaaagtatgaaaccttatgtaaatttagttgtggcagctgttttctcattgttgctgcagctggtgttattgttccagccataatagataataatgtgcataacgctatagtaaacagggatgtgccgggcacggtggctcatgcctgtaatcccagcactttgggaggcagaggcaggcagatcacctgaggttgggagttcaagaccagccttaccaacatggagctaccccatctctactgaaaatacacaattagctgggtgtggtggtgcccacctgtaatcccagctgcttgggaggctgaggcaggagaattgcttgaacctgggaggcagaggttgcagtgagccaagattgcaccattacactccagcctgggcaactagagctaaactgttctcaaaaaaaaaaaaaaaaaaaaaaaaaaaacccaaaaaacagggatgtgtctgctccagacatgcaactcatgggtcatgagctttgatgttacaagaatgcttgagagtctgttttggctactgtcaagtcatccatcttattttttagaagctaaaaaatccaagttcatgtgattttaattataaccatacttttatttaaagtgggaaggaacagaagattgtggtagcataaatcataagtcatctaatctcatttaggttatatgaaaacaagatggaaacctttgaagttagtgtgtttatttgctaatctacctccctcttcctgctgcacacatcacactgtggttctcagaattgttcagatgggaagtatttttttgcagaaatttttattttaaaaataataacttcagtgtctgctctaaatcaatattccgttggtcagaaacgaaccatcttagctaccactgttgcatcaaattttgcagctcatggaaataagccaagaggtttttatgaccattgataatggactaaaagaaaacccaagacagatagatgacagctgcaatgttcttggcacagctaaggtgggttgggagtgggtgtgaggagagaacaattcagaaatactttttaaaaaacaatctttcacccccacaatgtttgggggcttgtttatatgtatcattttgtatttttgtaacatattctattttaattttacctcattgtggtaagaccacttaacaggagatctgcccttttaacaaatgtttgagtgtatatacagcattattgactactggtgcaatgttttacagcagatatctagagctcattcatcttgcataactgaaactttaagccagttgatgagtgattcctgattttcccttccccgtacaccatggaaaccaccggtattctactatttgattctatgaatttgactagtttagataccgcatataaatggagtcatacagtatttgtctttctgtgactggcttatttcacttagcataatgtcctccaggttcttccatgttgtcacaaattgcagaatttccttttgaaggcagaatagtattccattgtatgcgtctaccatattttatttttccattcatctgttgatggatcttaggttgtttccatatcttggctatttgaatagtgctgcaatgaacatagaggtgctaatatctcttcgaggtcctgacttctgttcttttaaataaatacttagtaatggggttgcaggatagtattatagttctatttttaatgttttgagtaacctccatactgttttccatagcacctcaccattgtgccttcccatcaatagtacacaagggttccagtttctccacatcctcaccaacatttgttgtcttttttctcataagagccatcctgacaggtataaggtgatcactcattgtggtattgatttgtgttttcctaataattagtgacactgagcatttaaacaaaatttatttgttggccatttttatatgttttagagtttaatctatttcatattgtcctcttttctgtaataaattatgttttgttagaagatgcccatttgaacggtaacactttagttggccagtagagagttatttccagactgagtcaccatcagctgcatgtgctgccttgctattcatgcccccactcataagagcaggaagacaattcagtctccatgtactaggggtcctctgttcctctgctgatattcagactttataaactgaagaatgacatgaatcaatgaacaagactaaaccattcctaacatcttggtaatgcagtgttcaaaagatgttcttttcagatgcctagagcaaggctaaccaactgttatacactaactagtaactgatcatctataacaatagataacatagactggacactgttatgtgattcccatacattattttgttaaatctcaaaataaccctgtaatattttaagtgctatcaatatcctctcattccaattaaccaaatctctctgtgtgtctatatacatatatatatatcttataaatgtgtgtatgtgtgtgtgtatatatatatatgtacatatataaaattcaatcctctctacaaaatactacacttttcttattttcatcatatgggtgttatgttccctgaaacactgaccttgagaaataatcagccaattacagtagaaaattttaatgatttatattcaaagattgaagtcttactagatgtagcaatttctggtgaaagaaaagaaagtaaatgatttcttcccaaatggctcaaacagaaaaaacttggaagtagttagtgttgcatgtgcaattctctgactctcttttccaggctgatcatttcttggcagcatgcctgattatatctaggcagttacaccccagaaggtatattctcatagtcaggaatatgtgacagacacctctcgtactttaagtcaagatattatagctatctttacagctacacaatcatcatgatcttgcaaatctggagtcctcctggtgtcaccttttctgatccaaaggttcaaaatcgcttcaattctgtcagcatgtcaagtgcttacagtttctgagatggtgctggtggtttctaagggtgaatttgcaagtctccaaaactcctctctggagcttcttctggagatcacacactcaaatgcctccaggagccaaaagggtgaggtgcaagagtgagtgaagccaactgggttcaatacaagagacagtgatggtgctgaggcccctggagagtatgtgcccccaactagagcagcagctgctgctctgccactgccacaaaatgtcatgagggaatgcaggctctgtgtggccaactccagtcgttttttttttgttttgttttttgtttttcaagaaaacctggaaattcagatgtctgtgtaaaatatactgattgataaatgttggcaactaatacagatttctttcttttaaatacaatgcagcaagttcaccaggccactactttgcaacttacactttaggggttctcagtggggaagaaagtgccaaaatattctcctgcacttccctcagcagcttttcctctctgacctctcacaaccagaaggatatcataagcagtacttcccttccactaggaaggatatgagctttgaggaaagtgaggagcaggtccttcaaagaaaatcttgggctcccaaatccagccctttccctactgcctttggacagaggagtatgtaactcaagatcatcatagacaagaatgtgtgcatatttgggtttctccaaggaactacagccttgtagagcactgcagggcctctggctgaaataaggaagttgggaaagtaaagaaaaggattctattttcaatgttctgggcttaagagaacagcaaaacttccaaattaaaacaacttaagacattttgggtagattctcaatgagatttaagactaaaaattatatatttggcagctataaaaatagaagtgatatactcactcccccaatggggataccttaggtgccaaatttgtgtcacagtcaggactgggacagttggtaaattaacgtggactagaaccacccacagcagtgagaccttacagtgagctggagaggatgtctccaaccaggccatggagttggagacaaatcctccaaccagaatgcaggatttggaaccttggaaactcctaggtgattctttacagaaaagcaaagtctagcctcagggaacccagaaatggtggcgttccagtatccagacctgcagccgataccacagaaacctgtgtagagtgggaccatgaaaacagcccacttactagatcccagataatcaaactagttacaaatgagtttggcaaactcttagaaggcagggaactatgtaatcccttagaaaaattcttatcaaatgtttcagatgaatcccttctgaacttttacactctattcctcaagcagcattctccacagttcaacttttgctttcctgggccacttgaggaaggagcaggaacagagagagcagcaaaggtcctctggtcatcacaataagttctcagcccccataaaggccctcaagggtcaattgtactgtttccccaatggcgctgctgggagctgcttgattccacacctctacctggggaagggctgcagtgataatacacctgtttacagggcagagcgggagtaagtaaaacagacctcaaagaagatgaaggacagctttccattttttcttccttaggtctttagaattcatttgttatacctctctctaaatgattccataaactacatcttgaccacttaaaaagtaaaatggggaagacagcttaagccatcttttaaatcatagcaaatgccaagaaatgtctcagaggccctgtgatatccctttgcttagagctattttcattattattgttatttgccttggcagtcaaattctttacaagcagtctgatctgcaaatagtatgataataactttggggatgtcagccttgacattttattggtttgggcttcctgctggttcacctaggctatttcactttctaaaaccacacactttctatcccattcattatctagaggtccccacatccaggcagcagagaatgggcattgatgtctttacctagtgtaggacctctatacatctgtccagatatggggaaatagaaatccatcctctgaattctgtgtattctgagagagcttgaagtcagtttgtctgactagcaatatcctggtcaacacagggagggaggaagtgagatgagaccagccaagcagaagcattggccctttatagcaagaagccaacaatctatatcatctggtccaaagaggtagaatcctcccgcttcaggttaagacaacagtaatggccaaccataggagtagatgggcaggggcttctgagaggctgagggcgctaatgatgtctacacgatcatagatctagggatccagacctgatcatggaggatgggtggagatatggttcacctccagagaaatgggattgaaaacatttgatgaggggccaggatcattttgccatcagcttggattcagattcggtcccagctccacccatgaaacttgaatagactccagggccgaaagcagaaaactactcaaacagtctgctttctcttggcattaaggacactgcctccaaggcatgctgaccttgagggttatgatctccctcaagtcaccaaagagaaagtacaagtggagtagcttccatacccttgtcaaaggaggagatggatcttttaacctacagacctcactttcattgggccaaggtggggaccgagaccaatttattatccctaagagctgcctaggccaagaacaggagcaataaagaggctgaggtaggaaaggagaaaatgagagaaagggggtgggttattattaaaaacattggctaattcagatgaccatcttcaaagtgtccctgacttaaagtgaaattgcatgggcctagcataaaagctattaggtgggggcaaaagtaattgtggtttttgccatgaaagtaatggcaaaaccgcaattacttttgcaccagcctaata

SEQ ID NO: 2614 - DNA, 213795 bp, Homo sapiens
attattagctgaaactgcagagaaacagatatttttatttttaaattatcaagtgcattcacaagacagaaaaaaacaagcttgtacaagagtgactcaagctggctgggcccagctgtacctgacacacagacttatacatccagaacaatgaaaactcagtgccatcagaacagacttttgggcggatggctgtaggcttcaccagttatcagtgccactcaacactttcaaaaatgccttttttttaaagttctacacagcgggacatgtttaccaatttttatgcctctacatgtgcagggataagagccaaatatatttttattagaagatatttcacactgggtatacatctgggcaaaatttacacctcaatgcccaacattgtttttctcacttcttattttaatggaattgactgtctaatttggataggtctttctaattttatattagttttcactttcttggggttaaatattttatcagcagaccttatcacacacttgagaaaggagtcaagaaaagaacaaaaaatgaatatcccattataatatcaaacttcaaaacatatagtctataataatgacactattattctggaacttagaaaaaataaataatgcaatataataatgtaaaaatattaagattaaaataaatattaaacaatgtaagtctacaaaataggtatgtgcttaaatatgaaaagccttttttaaaaagtaaagacattgggaacattgttgccagtccagccaaaaatcacttttaatttaggtctatgaagttacctatatgatttgatcttaagaaacacaaaattttaattagaaagtaaattgttttcttttaatgtctttgttactgagactgttttgaatgcgccatattctaaagctgcttatcttttttgttttttggagatagagtcttgctctgtcccccaggctggagtgcaatggcgtgatcttggctcactgcaacctctgcctcctgggtcaagcaattctcctgcctcagtagatgggattacaggtgcctgccatgagacccggctgatttttgtatttttagtagagatggggtttcaccatgttggtcaggctggtgttgttgaactcctgaccttaggtgatccacctgcctcagcctcccaaggtgctaggattacaggcatgaggcaccgtgcccagtcagctgcttatcttttaaataaagtgaatttcaaaaacagatacttcatattctgggcatagcatcacacatacaaccattaccaatataataatattaaatgattacttaacagacatcctaataacgcaaacaccttttattcacatttgctgagtagcaattacagtgttttcttcattagttttccaacactggtaatgtaattatgatgcaattactaacaatataagtaccaatactttgaccaacaatagtcacaatggtttataacaactgaactcaaaggccacgttgatttttccacccacaacttgattctgatttttctagagtcattcataagaacaagaagtagtggatcctttcttcctccttagtatctgaaaattctgaactctgaagagaaattccatttggtttgtcattttcacctctgtgcatttcggcagctcttaacttttcttcaattctttactggaaagaaaaatacacaaaatgtactaaataaacttgaataatgtcttctgactacaaccaaatcttagtgtgctcaggcaacagcacaggtaataaaggacattgtgtaaaacacaaacacatacaaacacaactaaaaaagaccaaaatactaatttcctatcttctagtttgcctctcaaacattgttagcatctttttgtatcattagcaattgtttaaggcctgctcctgcattgacaggttaatgtaagcaagaaagaaataaaatccccaaatatagacactaaaaactccaaaccataagtaacttccagaaatgaagagcaggcaatcagagtatatgaaattcttcattgaatgggaaaaaaagtcctcatggatgatattcagggttagtgattcggaaggatacagataattttattaaatagcattctttcatttagtctatggctatgcctacttttatataattaggttattacatttttcaaatcaattaaaaaatgggctgtctcatttttgaccaagatagtaacaatcaagcatccagatgtggctttgatgtaaaacaaattatacaattcataaaaatcaagaaccaatatgcagatgaaacaagaagttgcttccttagacagcatgtagtatttgcactacaactagtgtgagataaattagtggggctaaacctaacattttttaatgcaatcattcatacagcattgataagttctggacttacacagaaaggttactgtccttcttctaaagagaaaggcttaacacctggttgtccttagaaaacacacggcagtttcagaacgatggcaaatctggttaaggtagcagtcaactccatcgaccactcctgagaaaagtgacagctggcacactgtggcaagaaagggcaatggctaaccattcctgaagggctttccctgggggcacaggaggtgtaggggacacctgtgctttaaggaacaggcccaatcttaaatcaatggtcgcactatcttttcatataaaacacatttacacatgaggggcaaaaattctttatcacttgatgtttcttgattttaaatttgttaaacagagctactccaggtaagcttgtatcatatatagaagcccaaaaatacgttctagtgaagctcatgaatgcacatgaagttgagtataaaaatggtacagaatacggcatgccaaggtataataccactaggggcaaaaaaagtctccctgtacatatacagaaaaagtacgtaaaactttcaccaaattaggatctgataaaaatggaaaagaaagtagtttcaatgaaggctgggctaaagtcacagagagacatataaacttctgcaaaaggcagtgaggagggtaaaggatcttacaggaagaataaggcaaaacaaagtgagaggaagagttcatgttagtgggaggacaaaaaagaagaagaaaaacagaaaagggaagggggagaaggggagaagaacagctggaaattagtgagatggatcctgcacgtgcagaagatgtaggacaagtgaaatcaatcaggtggtgactgcactgtgagaagtaaacagagaagccagacggaccttcaggagaagaacccaaagagaaattcaactcgaaaaatctaaagtaggcagcaaagataacatctttgagggaaatgattcagactcagaagaggaagaaacacactggatagagaatgacaaagatggcgcataaaagggagaaaagagacagaataaagatggtcatgtgcacccttcggacactggcggctcctcctgacgatgggaggaaaatcaagagtggcacactggcttgatgaacgctaacagcaaaaggacctgaaagctaggagacagcagggatgtgctgaaagagggaggagaagacatctaaccaaaagacaaggataaatgcaaagccattccttctctatcttctcataaagtatctctgtaatctaacagaggaagaaagtaacgaagcaaagccctttttaaaggctcttgtgatgaaaagagaaagaaacattcttcttagcaagcttatgaaaacaagtatgaaactaggttagtgtttgtgtgtatgttatgtctggggaataagattcataaaaataccgggccgtggccgggcatggtggctcatgcctgtcatcccagcattttgggaggctgaggcgggtgatcacttgaggtcaggggtttgagaccagcctggccaacatggtgaaaccccatctctactaaaatacaaaaattagccaggtgtggtggtgggtgcctgtaatcccagctactcgggaggctgaggcaggagaatcacttgaatccaggaggtggaggttacagtgagccaagatcgcaccattgcagtccagcctgggcaacacagcaagactccctctcaaaaaaacaaaaacaaaacacaacaaaaaaacctggaccttaccccacaagacattcaatccaatagatctttcctgaaggtttacttctgtggcaagacaccaggctaagtgcaggggaggaaaaaaatgtgagtatgtattaaataatagcccctgactggaagcactggccatctaatcagagttaatatacaaagcaatgtgtaagagaaacagccctgaacttggggcaagaagattaattcctagttcaggtactttgtagctgtaactttgaaaccttggtttctttaaatgtagaaacaacacgctgtattagaaaatttctaaaaattacattcattttgaaagaaatgatcaagtagtaaatatacagtaagtagataaattagaaaatgcacaaagttaaaatagaagaaaaaaattaccataatcttactactcagataattattcatgtcttttgatgtatattatataaactattttataatcattttttacttaaaaatcataaacatcttttcatgtccataaaaatacttccataatatgatgaataaccatatgatattctgttatataaatatttcatattttaatcaaccctttattttaaaaacactgctcgaaggagtagccttttaactaaatctctccatgtatacttgaatactttcctataagagattccttgaagttgaactgtcaggtcaaagagatgcacattttgaaaacaaaacaaaacaaaaaaaaaaccctaacatattacctaattatacttcacaaagaatggatcaatcttatagtattaccagcagtgtaagcgggaatccacatcccattttctcatcaatactaggtatgtatcataagtttgaaacttgtcattttgaaagggtaaaataccatctcattttattgttttaattttcattaatttgatcaatggatggtaaacatttttcatatgtctgttgccatttatatttatccctttaagaatcctttaagaatgtcctgtgtatatctttgtcccgtttttctactggtgtattttttttcttgttgaaaaagctcctcttagagctttttatttgttaagggtattactcctggccaggtgcggtggctcacgcctgtaatcccagcactttgggaggctgaggcaggtggatggcttgaggtcaggagttcaagaccagcctgggaaacatggcaaaaccctgactctattaaaatacaaaaattagctgggtgtggtgacacgtgcctgtagtcccagctactcgggaggctgaggcaggagaatcacttgaacccgggaggtggagactgcagtgagctgagattgcaccactgcattctaggctgggtgacagagcaagacgtctcaaaacaacaacaacaacaaaaaaaagagtattactcttccatgggtaaatctcttccatcccaggttattgttcatttaaaaattctatgactttttttctttttgacctgcataattttaaagtttccattatttaagaatctgttttataatgttttccaattctggtatcaaggttaaaaataattccttagcccatgattacataactatgcatctatatgcttctgtacaattagattttagttttctacaatggaaaaataaaaatatgaaaattttgactctagttcctacaaaatgacaaatttataaatgtggacatgaacagcttcgtaacatttcaccttgaacagaaacttcacttctacttaatagagaaaaggccttctggcaggccttccctataccccaacccctaccatccaaacacattttcccactggcgtatctcggtggaaaaagtggcccactcttgagctgtaatcctctggagttccttaggcccccagggactatcactctgctccgacaccgcagatggctccttctcaagtggctctttcctctcagtttgtaaatattcttgtcattcccctctttataaagatcttgtctataccctgtgttttccactagttactgcctagctttttctttcctttaaattccagcttctaaagagaataagactattcttacagtctttttccctttgggctggagacaatctgatttatgcttccaggtttctccatcaaaactatcttctccaaggtcgcaaatggcctcccggttacagatcccaaatgggacttgtcagtccttattttacttgcctctctctggtatttgtccttgctgaccatgctttcctaaatcttttcctgttgacaacatagcgcaactttctattggttttccccttacctctattagagtgacttttctgcctgcttgcttgttcttcctcatccgtgtatccattatgtgtccttggtcctcatggctctgttcttttctcatttcagaactataggagggaaagatcagaaacaaggagccagtaaaagagagctgagctaaaagctcagatgaggctttgatctagggccgtggcagtggaaacaaaaatggggataaatgtgaggatatgacagagaaaaacatccggcagaactaatgagtatacacggggatgagagacaaggaattgcttaaaataacgttaacagacaaacctttggctggttgggctccttcttagccatgataaagggacaagaataaaataaatttcaaaatcttaaacaattatctgtggacttacagaataaaataaatttcatctgtctcagaaaaatattagatgcctgggaaaaatcagaaagttctatcaacttaggtggaaacacacacaaacacacacacacacacacacacacacacaaaagtataggacattcattcatgacaagaaaagaaatgaaggaaatttatatataagaaagctgtaacatcctgatctgtggaatgaacaatgtagctttccaaatgattcaatggcaatagcaaaatataaaacaaatgttttgtggatgagtgtgtagtaatgcactttatattaggagaaagaaaacacaaaaacaatgaaaaaaaaaggaaaactgaagaatggaacagagtatcttctaagttgtctaggaatggtgagaaacaccacagaggagcttgaaaaagatacaagaatttcaaaatcaggtattaaataggactgaatagagattcttgtgaaccaaatgatatttccccaaaattcacatgttgacacctgaactcctaatgtaactgcatttggagacaggggcttctagggagataactaaggttaaatggggtcagaagagtggggttctaatctaataagactagagtccttagaagatggaaagatgaaaccagagcgtgctctttttgcacagagaagaggccatgtgaggacacaacaagaaggcagccacctccaagccaggaagagaggcctcacgggaaaccaatcctgctggcaccttgatcttgggacttctagcccccagaactgtgtgaaaataagtttctgtagtttaagcaatgaagtctgtggtattctctgtggcaccctgaatagactaatgaagaaatgtgtaagtaagtgaaatgaagtcagatgactgagaatgaaaaggtcagaaattacaaagaagaaaggacagtaaatttagatagaatgataaaagaacaaaggaaaggttaagctctgaaaaaaagcactgatagcacacaatcttaatctttctgaagtgtacccttttggccttatttccaaggaatctatattctagactgataaggtgaataagggaagcaagccaaagataatacagcagagacaacgatacaatggactgtggcaaactggagaatggatgactcatctaaaggaggcagtctatctcagctcattgatggatgtcatcaaagaatgtagagctgtggtccagaactctggattattttcaagaagtcagaaatctgtatttcttttaggtgaaatatgtaaatatctgggcagctaattacacacacacacacacacacacacatacacaaacacacacacacaaagaccccatggatacttgctggtctgagggtatcccaggcactgccctacttttgtgccttagctcctgacttctaggccctattcttcttgtttaccccgtcgtgtctatatggtcttaaattctgtcttcatctttggctttctctgaccactaaagcccactctaggaagatcagactgtagtgatcctctttcttcttttatctctcacaatctatatacaatctatcaaaaggctaccttgaaaatacatagaacatctagacctttgcttgtagcccagatagagtaggaggaaccacatttacctcttgtctaaaacaacaacaacaaacctgaacaaaacacatgaaacaacaattttcaagatactgagccacagacgatgaagatctgcaaaaggtccccctcaagtatccagcagtgaactgatgagtgcacacatctgggaaaatcacttgaggcccggaacagtgtttattcccactagcaatgaacagaactgttcccgaggaagcccagacactggccttactagacaaagacttaaaatccgtaattaaaaatgtgttcaaagaactaaaggaaatatgtataaagaactaatgtatgagcaatgtctcatgaaatagagaatatgaataaagaaatagaaattacacaaggaggaagtaatactaaatctacacaaactattctagaaaattgaagaggtgggaatacttcccaacttgttccatgaagccagcattatctcctcatcaaaatcagcttaagatgttacaaaaaaattacagacccatatttctcatgaacaaaatgcaagaagttctaaaggaaattttagcacatcaaattcaacaagcactatcctttataaaaaggataacacaccactaagtaggttttatccgaggaacgcgaagttggtttaacatttgaatatcagtgtaactcaccatattaagaaatttaaaaacaaaaaccatagattacttaactaatgcaaaaacatgtttgagaaatcaaacatctattcctgacaaaaactcttaggaaagggaaactacctaataaagggcatttataaaaaacctagaataacatcatacttcatggtaaaagatcaaatgctcctattcatttcccacatgatcaggaacaagacaagaatgtctattctgactagttttattcaacattgtattagaggttctacccagtgttaacagggcaaaaaaaaaaaaagaaaaaaaaaaaaaaaaaagaaaaaaagaaagaaagaaaaggcgcccagattgtgaagaaagaaaactgtcttttatttgcacgattgtctgtctacacagaatatctcgtggaatccactaaaagctattacaactaacaagtgagtttagtaggttcgcataaaacaagatcaacatacaataatcagtagtatttctataaactagcgacaataccatttacatatgaaacatgtaggaataaatcaaccaaagacctatacactgtatgtccaagacctatacattgaaaactaaaaaatgttaccaagagaaattaaagaagttgtaaataaatgcaaagatatatcatgttaatgactcagatgattgaatattgttaaaatgtcaattctctccaaattagtatctggattaaatgcaatatcaattggaatatgctatagaaattgataagctaattctaaaattcacgtggaaatggaaagaaccctaaatattaaatagccaaaccaaatttgaaaaggacaaagttggaggactaatattacctgatttcaagacatactacaaaactactcagtaattaaaataatgtggtagtagcataaagacagaggaatagaaaaataatgggctgggtgccttggctcacacctgtaatcccagcacttggggaggctgaggcgggtggatcacttgaggccaggagtttgagaacagcctggccaacatagtgaaaccccatctctactaaaaatacaataaattagctgggtgtggtggtgtgcacctgtaatcccagctactcaggaggctgaggcaggagaatcacctgaacccgggaggcggaggttgtagtgagccgagatcatgccattgcactccagcccgggtgacagtgcaagactccatctcaaaacaaaacaaaacaaaacaaaacaaaacaaaacaaaacacccaacattagcttgtgtagtggtgtacgctacttgggtggctgaggcaggagaactgcttgaaccctggaggcagaggttgcagtgagccaagatcacgccattgcactccagcctggatgacaaagggagattctgcctcaaaacaaacaaacaaacaaacaaccctccccccaaaaaaaaccaaaagagaaatagaaaaataatagatagaccataaacagacccacatatatattaagagctgatttcagcaaaggtgcaaaggccattcagttgagacagagttgtttttcaacaaatgatgctagaacaacaggatctccaaatgcaaaaaaaaaaaaaaaaaaagaaaaagaaaaaaaagaaaataaactctgatccaaaactcacatcacatatcacacatacaaactaactgaaaacaattcatagtcttaaataaaaaattataaaacttctacaagaaaatataagagaaaactttagtggctttgggttggcagaggtttcttagatattatactaaagcatgatttgtaaaagaaaaattttggtaaacggaacttcaacaaagtaaaaaacagtttgctcttcaaaagtcactgctaaaagaataaaaaggcaaaacacagatcaggaaaaatatttgaaaatcacatagttgataaagaacatatttagaatatataaatgactcttaaaatttaataaaacaaataacctattacaaatgagcaaaagatttgaacagaaatttcaccaaagaagatgtatgcatagaaggtaagcacatcaaaggatgcttaacatcattagttgttggggatatgcaaaatcaaacaacaatgatatatctctacatgtattggaatggctaaattagaaggactgaccatatcaagtattggtgaggaagcagaactcatacatgttggtaggactgtaaaaaggtaaaaccgtatggaaaacaatttggcagtttcttaaaaagttaagcataaaccaactatatagtccagccattctacttcaagatgtcacccaagaaaaatgaaagcataaccttcttcaatgcctctttcagtgatatgatgttaaacaaacaaaaaaaacccctatgttcacacaaagacttgtatataaatgttgatattagcttcatttgtagtagccacaaaaacttgtacataaatgttgacattaactttatttgtagtagccgcaaagtggaaatgattcaaaggtccatccacaaaggtacatgaataaacaaactgtggtatttaaaactctagacagtgagagaaagtagatcagtgattatcaggggatgtggctcagggaagggaagaaagatgtaggagggcaaaattacaaaagagcatcagaagtcttggagagatgggtatgctcattaccttaattgtggtgatggttcatgggtatttacccatgtcgaaacttaaaccgtttattttatttaatttcattttatttttttgagatggagtctcactctgtctcccgggctggagtgcagtggcacgatctcggctcactgcaatctccacctcccgggttcaagcgattctcctgcctcagcctcctgaggagctgggattccaggcgcctgccaccatgtccggctaatttttttgtatttttagtagagacaaagtttcaccatgttggccaggctggtctcgaactcctgacctcagatgatccgtttgcctcggcctcccaaagtgctaggattacaggcgtgagccaccgcgcctggccgcaatttattttatatcaagtgtatctctttataagttagaaatatatatgcatacataaaatctgacctcttttcactaacttcatggctcccacttttttccgaggcaccaccaccaagtctcacctggataatttcaatattattttaactggtctctctgattcaacccttgtccattaatgtctattcttatcttaaatgtcagagggattctgttaaattgttaggtcacttcctgtgtttaatggcttcctacttcacttggtgtaaaagccagaagtcttataatagtatataaggtcttattactgtctctgattttatccaatctctcccagtttcttactctactctaaaaagcctaatttccttacttttctttgagggtaacaggtatgcttctgcttcagggcccgctgcacttgtgttctacatactcacattactcaattccctgcctccttccacttttctcaggccttctctcatgctccgatttacaactgcaaccttcatgtctcctttcctttcccctacccatgctttatttttctccatactgtagcacacatctggtataattagacattttacttattttgcatataggtaaataaaatgttagctccttatagcagggattttttatctgtttactgctgtaccctcagtgcctagaacactgtgtgtgacactgtaggtgctcagcaaatctatatttagcaaatgactattacgtgtctgtcttccttgccacactgggcacttccacaatgtacaagttgtgtatcatatcattcatcactgcatttcagtacctagtatagcacctagaacagagagcagatgatcacattttcccaattggactgatgctcacaaatgaactactgacaccttcaaaggctaatcctgacccttcctctttatggcagtagcatcgaggtctaggacaagaccaaattcttgatacagacaaataatgtttgctcaggctcatgtaaaatgctgggcaaatacagcaagacatgtctcctggccccaccttccaatcatcagatgccctcaagacactcacattgcattcttctagagccacaatctctatcctgtttttttctcccactgcaattccccaactccaagacactaatcagtcagtctcctcccactctctcccctctcttcatagccgtatgctcctttaaactagttctttcccacatcacatccaaatgccctcccatgaggcagacaaaaactcaagccttacctttatctagaggccttctctagctatgcatattcctcctgccttctcattcagctctcttctgtaattacaatttgcatcacatcattttgcacctaattatataattggttgccttctaaatgcttcttatttctatttcctcatctgacctgtaatgcttctttaatatctctcaatgcatctagctcactgctgggcacactgtgaggtcacacacatgacaataaatgcctttaattttagaaattgggggtaggatgaggattaaaaaaaggcagaaaacggataataaaagtaaaaatttagaagaaaagtggcaagtagcaggattattttagaaaaaaaaatgtggactataaactacctcctcataaagagaaatgaaagagcctggaatggttattataaagatggaaaaaaatatacagtggagtgacaggatgcttggaattgacatttatagccgcaccatattaagaagagatttcattcatttagttcagatttcagggttaataagactttaatatgattaactatatgaattaacctctctctgaacaaagctgttaatgaaataaaggttgctatgttaaaaaaaacccaacaaaattcaatacaggctatattagttaactatggaacattaatactacttgttaaggatgacagcatatttatagcagcctcattaccaactctgacttaggcagcagataatatatgaagaacatcacagggcatgcggtacaaaatgtagaagtttaagattttcaggaaaatacttttgttaaattaaccaatagaagtttcttctagataccttaaaaaagagaatgtaactttactaaaatgtgtataaattgcttgcatagaagtgactgacatttctcaaaaaaaaaaaaaaacaaaaaaacaagacaagaaattcaagtggaaagtagtaagaggctgtctatgtggctcatttacatatattggtcaaccaactaataagcaaaagttacaaactcaaaggcagggctgcaaagaaacaaaaaattagcctctgtccatttacttgggtacaagaaactcatttaggtaaatcaaagaaatgacttctttgtacatgctgggctctagtgtttccaccatcaactcgcctacagttttcaagtcatgagaaatctatcttaattcatccttacttctaagaaattgtaagtagggaaagtccaaaagctttagatgaacttgggcatttagacatatctgaacttctcatgaaaatttttattttcagaagcatcttcaaaaagagaagctgagctatactgacatcctttagaagctgagatgtttgtgaggttttattgaactttaatctggagggcatgacatggatctctgtatctcgtgaaaactggtatgaaatgtagaccgagtgaggagtatgtaggagacattttttcatttgcgtaatattaagtaaaaagttctaaaaatttttatgaaatatgttcaaagacaccaagagcactgttcccatgatgtgttaaacatggtcatttttttttggttgttgaaacagtctgtgcttattgtttctagtgtattttgttgttgagtatacgctccttagggtcagtgactgtttatctactattatgtaaaattttaaatgtccagagactggaactaaaaacatatctgactgataacagtaaaacaagaaactataaaacctggagagattatagaaagaatttctaaggtatcttctagatcatgattctgtgactcttaaaaattacatttgtctttcatctgtacaatgaaatactgtcttgttaaatgctgcatgattttattagacaattcctgtaaataactgtcatctgaatcagaatttttgtactggaagagacatattattcttcaaattgccaaagcatatagcagggttaacttgaacaaatattttccccaaggaagctcagcagggattgtctgtgtgcatgtgtgagtaagcaagcacccagcaatgtacgtgggggtggtggtgatgggatgggagggtatgatagctaagctgttcaatgctgtcacacttccgttatattttgttagtaatgtaatttgaatataaagtttggacataatgttaggtccaaaagataactgaaaatgataaaaattgagaaatatgttgggaatgttttgatgtaaaatttttttttgaggcaaaagagtgacttttgatgggtacattaagtgacacagcaagtactaattaaaaatataaaaactttccagagttcttttaaaataaatacttcaaaataaattacccaaatacattaagcatttatagaaaatatataatgacaatgttctgcttattagcttttttcttaatgcttcaaaaaaggcattcataattttacttttaatacacgttcacttgttttcagttaatgttatttcaaaatagtactcaaataaaaataaatgacaaaataggtcctctaaagttttgtgtgatactagtttaataggatttcttataactttgtaataatacacattctcagagtccaactattaaaatattcattgtttaaacagccaggcatggtggctcatgcctgtaattccagtactttgggaggccgaggcaggtggatcacctgaggtcaggagttcaagaccagcctggccaacatggtgaaaccctgtctctactaaaaatacaaaaattagctgggtgcggaggtgcgtgcctgtaatcccagctacttgggaggctgaggcaggagaactgcttgagcccaggaggtggaggttgcagtgagctgagattgtgccacggcactccagcctgggtgacacagcaagactctgtctccaaaaaaaaaaaaaaagaaaaaaaaatcgtaaacaagctaaactcctttaaaatcaactatctgaaatttaacttatagtttgataatgttataaaaataagaaatggagaaattatccttaaaagaaaaccccaaccatttatcactgcaaattattttgaagaagttgcttactgtgtcatagattctgagcctagtctgaagtcctgggacttgttcttattgattgattgctgtggaagaagaggaaaaacaagtagtaagtaaaaaatgagaaaagacaacacagtcaatattcacatgctgaaaacccaccaacttcctgaatggggagagaatatgcctgttctgaacaggaatatctatgcctgtcctgaacatatattgtctatcaggacaatatatttgctcccatgaaaaaccaaggaagtagttctccagagagttcaaacactcatttataagtaaagtcagctttcaggtatgtgaccaaaaaaaaaaaaaaaaaatcagttgtgaatcagtttaaattaatctcccaatacaatgtggtatattacttaagctctaaatatatcttttagcctgcatctttccttcatattctttatagtatactctatattttcatagtaatacacattgatctgtatgcaagagtttgaatttgaaagctctttaaatctacaaaatgtgttcagtatatcttgttttattaatggcaccttcgtgagaaaaacaataagcactttcaagggtaccaaattttaccctgagcatcggatacttcctttagaatctgaaacattaacttcatattaaagtatactgtgggaaattgagtttgatatgatatataatctataaatcaacctaatgttgctataaaacgaattgcaattttttttagagataatcacgttatggaaaggattcgtttaacactcacaaagaaaatataaattgttactatgtttaagttcaataatatacaaatgaaacagatataccatatgttcctaattatttcagtaatccagaaaacataaaaacaaaatgaaatgaaagaaaaggaatacaaccttctctttcagtcttgtttgagtaactgctttcctggtgttatctctactgaagcttgtttggcctttttagatttccttcttcacaatcagatttctgcaagatcattcttcagcaagatttggcactatctttaaacaagcattacttttcttacagatttcaagaggatattatgcttttctggaccataattatatgattattactgctagctgtagagctttaagtcaagcataataaaaacaagaattaaagagcaaggagactttttggtgaaaggtgagtgttgcaacaggtgacccatttggtagaacaacaaaagaacccatgacatcttaatttttctccaccagtggaattgctctgactcagttaaaacgtgtttgggaaaaaagtacatacacacgggaaatttcagattcaactactaattcagactgccctcatccaatagaacaataagcaaagaaaatcatcaaaacctcagaaagcaccatcataacagaaattatcctgtttctttccagacttgtgaaataaattctaaacacagcagtcaaattaaatgtgaaatgttttattcttttcttttttttaagagattgggtcatgctttgttgctcaggctggagtacagtggcatgatcgtagctcactgcagccttgaactcctgggctcaagcaatcctcccgcctcagccttctgagttgctgggattacaggtgtgcgcctccatgtccagctattctttacaaggtctcagtatcatttttctctctttgcccatggcaagaccagcaacttaccatcaatataggtatatatgaaacttgataaaacttttcaaaaaactcaacattaagggctctaatcagaaattctcatcaatttgaacctattccagaggttgaggggagagaagtcatactgaactatataccagtgttaagccaatgttacttttaattattttttgttatcctgaaaaatgaataatatgttgccatgtgcaggtcttgccaattctgctaagcctgttcatgtgaaatggatgctgtgatatcctcagaaagtttgtcttaggtatgttaaacatggtccctgccatcttttctactgtgtattcctatcactggcatacccaaatcctttttaatgatgcagaggcagcttagcctgtgttcaaattatatgaatcctaagttagaagggggtccacattacaaagtttaccacttacttgaaaaggacacttacttaactaggaccaatatttgacttccaaacacctttactcactcattccttggtctcagcagcagcacgtcatataggtagttactcatggaggcagaagcagggggaagaaggaggtgtctctgtgagctgttttgttttattttacctttaaacgaaaaagcccccaaggctggtgttcaatcagcccgcaaataacccccaccatcgacaacgccaaagaacatgactgcccttctttccacacacacttgttagaaagttgttttatgactttgtttcctcttcatggatatcattgatttagagaggaggggatgaagagaggaaaaacgagcaaagaaaaagtgacgagtgaaaggaccagaatctagagacttgcgctttccaaaccctcacaacttgttagtgatgcttttaaatttaaatgcaatgatagttaacataaaataaatgattaatggaatgattaaatgcttccactgattatgtggaaatttataaggaagaaaacaactcatagatagctttgtaaaagagaaaggggctatgcaaacaattcccccaaatatttttataaacttgaagaatgaatataaaattaggttaatgttcaattaatgtatgttacatctagcacacgagacttaaataaggcaaatttatgatacggtatagttctatttttacatgcggcttatatacctcatgatagatataccttttccatataatttcatagtttgtttatatctactttgtaggagtttttaaaaaaaggatgtgagagaggaaaaacaactaaagttggtggttcaattcttgtcttggttctgtcattaactctgtgtggcctgggtaaaccacttagcctctcttggggtcttttttttttttcacttgaaagtaggtgagggttcaaaataaaaacataagcatcatagcaccattctcttattttacagaccaggaattggaggcccagagttaccaaggttatagaggtagtctgaaggttatactagtgtttttcaaactgatttaatggcaaaactattttcaatacaattttattcaaaaggctcatgtataaatatgtgaaagaagaaatactctgggtgaaactaggtttgcatggcctggcaccccctgcttcccaaccctatgcccccagatccctgaggaatagggctctgtaaatgacagtttacaaactactggagtatacaagctctaaacaagactagaaaggtttcttttattgctacaactctgtttccgggagcacaattttaggattttaaatattcacataagtttgaagttttctttgactttagaatgtatgtatgtatatatttgtttattcacttactttctaatttgagacaggatctcgctctgtcactcaggctggagtgcagtggcgtgatcatagctcactatggccttgacctcctgggctcaggctaacctgtgggctcaggccaacctgtggcctcagtctcttgagtagctgggactacaggtgtatgccatcatgtctaatttttttgattttttagtagagatgaggtttcactatattgtccaggttagccttaaactcctggcctcaagcaatcctcctgccccagcttcccaaagtgctagaattatgggcatgagccactgggcccggcctgatttcagaattactgataatgtatctggtttacttgatgttaaatcctccaattataatgctcttccttaagggaaaaaattcttctgtattaagatgcagtttctagaagcatactgtaacaaaaagtgaagaccgccgggtgtggtggctcacacctgtaatcccagcactttgggaggccaaggcaggcagatcacaaggtcaggagtccaagaccagcctggccaacatagtgaaaccccggtctctactaaaaatgcaaaaattagccgggtgtggtggcgggcacctgtaatcccagttactcgggaggctgaggtaggagaattgcttgaacccaggaggcggaggttgcagtgagtcaagattgtgccacggcactccaacctgtgagacagagcgagattccatctccaaaaagtgaagaccatcctgatcacgatttgtagttttggatactaattgtgccaattaaaaacaataataaatacttatctgtggggcagcataattaggagggtgttttggaagataaggcaaaataggtgagaacatctatttaatctttgaggggtaagacctagataaaaacttacgagatttggactttatagacaaatatggagccaactaagatttatgcactggtaagtcacatgatttgttttctattttaggaaagtatcttcaggaggcaggtaaaaggtgcaatgaagactgaagaatgggagaatggatactgttatcagcagagaccagaaggctatataccaggcagtggctgttacacagaaatatccttcccaagttcgttcccttcaattcactctaaaaaaaaatggcattccttaagtccccgtcttctaccctttgtcattttcattcttgacactcctctattcccgtggattcagatatcaagttttcttcagaatgtaacaacttagcaatggttagttttcagcaaagcaagtttaaatatagcaatttttctggaaatatacttggattcataaattgtaatcaaaactatcttgcaaatatgagttttcagcaaatctctcttgagcctcatagatgtctgcaaggtatctgcaattggttgttgcaggtgctatgaactttacatgtctcaaattgaagtccttcctacattcttaaacactgagatgtttcaattagaaagtcagatttcttttccttcacatggatttagtcaccaattcctagctccttattatttttggcttgaattattgcaacagccccttctggtcttatttctttcagtaggcttttcccagtctttcagagcttctagaaggagcttttgaaacaaccaatatgatcatgtcatccccttgctttaaatactttgatggctccttactaccttcaggataaaattcacctccttaacatgccagccaaggacctcctcaatcctgtccacttgttcaggtctagctttttctgctttcaaccttgcatcctaagctgcagccatgatgaaacatttctggccacagcaggcttttgcacatgctgtttctaatgcctcaaacaaatcctcccacccacccggctcctcttaaaacctaattcatccacttctcaccacatggtctcatagtttcccttcactatccttttattgcttttatgtttcattttgtgactctctgattaaagttactttcacctgttagactgtaagttccataagtgcaaggactatttttgttttattgaccattataccatccagactgtcttctactacagtgcacagaaaaccagcaggcactcaaagtatgtgttaaatgaataaataaaaatgccaatgctggtaggtgagtggggatggggatcactgattgaataaggaccagaagaatgtgagaaaggaaaatgaccaaaagcacaactggagaggtctgccatagaaaggaaaagcagttccttctctgatacctgaaaacagctgcaggagggtaaaattacagaaatatagagaaagtagggatgaaaatgtgaggggattcatattatatggcctctcttcaagaaagcagaagaccaagtcaacttggagtaagaaatcagcagcttgagtgagaaacgtggacattcttttctgacctgctgctgtagagaatggggtagagtcagtagggaaaaacaaaaaagatgaccaagaccacgggcctcgctgaggaaagtaatcacaaatctcatgaagagacagtgtcaatacaatactataatttttacaaaagctatggttaaataccagagtagaagtgagaaaaatgggcaacttgttgtgcccccaccaatcctgggcactagtgaaagaaatggacaactaaatgtccccccaccaggcctggggattggtgagacaagtgaaacactccaagtgctaatgatgcatctggcatcatattgctaaataatcctgcttttatttcctagtggtctgagaggcccggtttgagaagaatgaaaactgattgcagacaaccacggaagcaagaagcaccagaatgcactccctttcttagaattcctgcaaactgaagggtcattgggttacccacttcctcttttgggactaaactatttcctaatctcttatcactagggaatagttcttcccaaaccaggtcacccaaatacagtggtgtgtaagaggtggctgcttaaaaacgcctatagcaatggggaagcggtaagagaggtaaaaagagaacagactcattaagtacaaaaaaattcaaataaaagagtaataaaagcaaatttgttccaacatgttgaaacatcttttattgtatgcatggcttgtctgaataaaagacacacttaaataagaaaaagttcttccctttttatgtacctaaaggggaaccatattaaaatgagagaccaatatgacccattactgtgactgctaagtaattataaaaataatagcatacagttgattttccatagtttatgaaaagattagcgtatgtttaacttctgaaacaaaggaaattaacattagtcaatagatatctaaatttaattattagacattttatatatactcatcactttgagtctcacaaagctggatatatctttatgtaaaattcttgtttttaagtagggtagtctacagcttgtttttaagtagggtagtctacagctcatatacaactactcatatactggcagttaatggaataatgtaagcaaaatttcattacaggatcttaaaatgaaaagctttttattttacttatgagtgttttttcctttaattacaatatttataatatgtaattcctttaatacttataagtgttttttcctttaattacaatatttatattgtaatttatatatattatacataaaaattaaaatatagcagtggttctcaactggagagtgaggggtgattttgacccctggggaaatctggccgtgtctgaaagacatttttgattgtcacaagtgggaagaggtgcatctagtggacagaggccaacaatggcactaaccatgttataatgcacagcatattcccaacaacaaagaattatccagccccaaatgccaacagtgccgaggttgagaaaccctggaatagaatggttgacaaaacaagaggacagcagagttagggtgacggagaacttccaaaaaaaggtcatgctgcttgtcgagtcagaagacacaacgactgatactagtcaatttggccactgtctaaaggacaatttatgactaggaatgatgggtgggaagttctctcaataacatctttcacattttagatctgtagcagacttttagagggatgttactgatatttaggttaatcctccgctttttttttgtgacacagagtcttgatctgttgcccagacttgagtgcagtagcacgatcactgttcactgcagcctcatcctctcaggctgaagcgatcctcccacctcagcctcccaagcagctgggactacagatgcacactaccatgcctggataatttttgtacgttttatagagatggggtttcaccatgttgcccaggctggtctcaaactcctgagctcaagcgatccatccaccctggcctcccaaaatgctgggattaaaagcatgagccactgtgccctgctgaacctttgaaaaaacatcatgaagagcaaatatgttacctgataaaaacaagccttagaatttgagaatttatagtattctctaaactaagttttaatggaagatctgtgtaagaaaatgagatgtggcagagactaagctcagagactcaaatcagctaaataaggagtgggttgctaaacagaaaagcaattcatccctaggttattctgtgaaacttttaattaacgagaatttaggaagatatcgaggaaatgacacattccctaaaccttgttctgaagttaaactacagggggattctctcatgttcctttcatttcagaaccactggcaattatctaggtcctgccttcaggctggataaactgagaagataagcagcctgcagggtctcaccttgtagagagttaagagggtcctggaaatatggagagcacttgcccaaagtggcaagaaacagggctgttgtgggagaagagacacagtaggggctgaggtacatatatcaaatacaatggcagaggcacaggtggaaaagaagcagtcaaacaagttgccagaccttcaagagaataaaggccttataagttcctttcggagtaggagagagtccctattaatttcttgaggctttgagattcctctgcgtaggtcatttcaggactctattgttgggagtggaatctatgggtatgaggtaaaggtaactcacacaggctttgctgttacatcactgggataccacccaccttctttatgggacacttatctctctagactccagaataacacatattattcaaatgtaaataacatttatatgaaattaatacttttttctcaaaataggtgttataagttattgaaacaaattaggggaaagaaaaaacatattagtgctatctgcattgaaattcttcctgggacacaaataagcactttagttttttttttttttttgagacggagtttcactcttgttgcccagcctggagtgcaatggcgtgatctcagctcactgcaacctatgcctcctgagatcaagcgattctcctgcctcagcctccgagtagctgggattacaggcatgcgccaccacacccagctaattttgtatttttagtagaaacgggggtttctccatgttggtcaggctggtctcgaactcccgacctcaggtgatccacctgccttggcctcccaaagtgctgggattacagacgtgagccaccgcgcccgcccgcaggttagttttaacttacttataaggtaaggcttcaggtcagtttcatcactatccttgatatatacaaagttagttttgattcagttctcttcagataaagtaagaaaacttcaaatattacaaaaagtttaaagcaaatccaagcataaattaattttattaaatataatagaaataaatcactgtattttctttgaacagaattactaaagtaaaaaaatacaaattgatattattctttagcaatagaaaagaagcaacaattatgaccatatttccaatgatttagtatatattaactaactactggctatttggaaaacctgtttcaccataacaaaaatctgcactgtctattataaatttgttgttggacttaatataataataaatcatattattcctatgattaacaataattcagattcattcctggtacagggatcagtaaatggaaaaaaattttctctataaagtgatatttgaaaagtgttatacagcacaattattagatactttgaagactaagaaaaacacatgcacattgagggcaatatatttattgcctaccatttttctgagaggctgacagatttaccaatgtaaaattttgcgtgtatgtgtgtttggctggaagaggaactaccatgaagttatctaatgcttttgggttctctgttcttgttttgaactaggcaagaaagcagctgttcctgaaaataaccagagtgtacactttggtttagaatagtctgtcctttggaattaagccagcatgctcttattgactctacatgcttaataaaataatgaaaattattaagacattcctctgctcatgtgaagattagctataatagatatttttataattatcttgaatagcaaaaccaataactgttattcatttagtgaatttttagagaagaatataagcaaaaataacagtagtttctccacatcttcaaaaataatctaacatttctgtgcatacttattactgtacatctagcatttatataaaaacatacttgactgtattaatgttgaaacactaatagaaggtaaatagtactttactactttgggttttgttttttagaaataaagaaaaaagaaaacagcattttcaggaattaaaaaaacagattttaggaattaaaaaaagaaaactgggtattttggtacctaaaaatggttaaaaaataggattgtctctgctaataagaaaagaggccaggagtggtggctcacacttgtcatcgcagcactttgggaggctgaggcgcgcagatcacttgaggctaggagtttgagatcagcctggccagcatggtgaaaccccatctctactaaaagtacaaacattagcagggcatggtggcccacatctgtagtccaagccactcgggagactgaggcaggagaatcacttgaactgggaaggcagaggttgcagtgagttgggatcccatcactgcactccaacctgggtgacagggcgagaccccgcctcaaaaaaaaaaaaaaaaaaaaagatgtcaaagatatattgaaaaaagaaaaagcagaatcttaagtatgatcctagtttcataaacataaaaaatagacaaagacgtgtatttatatatgcaagaacatttttgtaagcatatgtaagaaacagaatgagcataaatattagcaggacagaagactaatttttcgttttatactattcttcactggttaaaattttaaaactatgaacatgttattttttatagtagaacaactctagtaattaaaacaaattttagtaataactttcctccccaaataaatggatcataaaggttaatgcttaggctagcaaaaataaaaaggctaaaaagcaaaaaaagtccaaaacacaaaaaatagaacaaagtttgtcagcactactcgttttcaaagcttctgagtttctctccttcctgataatacttatattctcttttctgttagatgcaatttgtagcacaccttggtaaaaatgttctggaatgaacttggaggaaaacattttcctgctcccactcccctgtggtataagttgttactgatttgtttcgggatgattaactcatctcgtcccctcctcctccagtgaagagccagcaacaaatgctgccatcacccactaacatttcaatgaaccagatgaaatgctggaaggtacctggcacaattagcaacagagcaggtgtgttccacttggaagaacatgtaagatgcagcagctgccaagctattaagaggtataattttgcttcttattctatagcttgaaaataaataattttaaaaaggaaagaaaatgattgaggtttgtttccttttttcattaaaaatatagagtacaattcttaaaacttacacatgaagaagggtacaatgaaacaaataccaaacagggatgtgggctgggcacggtggctcatgcctataatcccagcagtttgggaggctgaggcaggcggatcatttgaggtcaggagttcgaggccagcctggccaaactagtgaaaccctgtctctacttaaaaatacaaaaattagccaggcatggtggtgcacgcctgtaatctcagctacttgggaggctgaggcatgagaattgcttgaacttgggaggtggaggttgcagtgagctgagatctcaccactgtacttcagcttggcaatagagtgagactgtttcaaaacaacaacaacaacaaaaaaaaccaaccaaccaaccaagcaaccaaacaaagaaaacaaaaacaaacaaaccaaaaaacaaccagggatgtaaaaaaccagtgtgatacagaacctggctaactgtgcaggtaccaactgtatgtgtgtgttgctaactaggtggtggaggaaaatgggcactggcctgagaatatggaggccatgctcctaattagcagcatcattttaaacgaacttcttatagcttcccggatctcaatttcctgtagaatgaaggagttgatcagaatcaccaaggatgttctctaaggtcctttccatgtcactagttctgtaattctatgaacttagatgccccacaattttagtcactttatcacagacgacttttcatgttctttcttaaaaaaaagtgataataaaaataagacttgaacatgaaattaaatatctgatagactctgtgggaggtttataaggtaaggtcttgataaaatcaaaccatatatattttaataaaggagctaaatttaagaaatgcaactagccaggtgctaagaagctcagttacacgtttctcaaaagttggctgttagttccatgactcagagtgcactcaaatcattttaattactcgaggcaacattatatttcttaggggcttcttttccataaacatagatcatttgttataccttctctcactgggaagtaaaatactgtcttacacacatagcacattcctaagagaaaaaaatatatgcaggattctactctaacacgtggattcagatagagaagatcaaatcatgttcttcaacaaaagaaatccacgcatcttaagatttaaagcctaatttgagttccatatcctccatgagaacattcctactcccttgcccaaatggagttttatcctctgccactcctttacatgactctaaattccttaaatctattagaattaaggtttgggcatcagtgggattagcctgaagtagacctcaagggtgactgacgatggtatctgaagaactggtctgctgcaatatgaatatgaaggtatgtttgaagcatggagatcactctatgaggggcaaaagtcataggaaatttgaaaaatcaactacagtctaaactaagactatgatgcagtgagtccacctaagtagagtggcacaggcagtgagaactgggaagttttggaaacaagtaggaggtccctatccataagaacacaggcacatcaggaagaggaaggggcaataccaacttcacaggtaagacactgacagagttctttatgtttcctctggcagagtcaatgttaactcaagggtaatagaaacatactaagggagggggggtcaggtcacctcagtttcaaaggttaccgtgttgcagagtcagggacatgagaaaaatcacaaagagtaaagactgtatgtttcatagcatcacacagtttttaatacagactaaaagtattgttagctgtcacagcaaccctttacaccaatgttataaatgcttccactgcattaaaggtttttatgttgtaaatttagacctcaggtttgtgttatgtttgtgttaaccttatgtttatgttatggacctcatgtctgtgtaacccccaaattcatgtgttaaaatcctaactctcaacaagatggttgttaggaggtatttgggaggtaattaggtcttgagggcagagccctcataaatggtattggtgcttttataatgagagacacaaaaaagcttgcttcctctctctgctctctgcccagtgaggataagtgaggttgcaaaccaggaaggagactttcaccagaccctggatctgccagcacattgatcatgaactttccagcttccagaagtgtgagaaaaaaattttgttatttaagccacccagtctacatttgttacagcagacacaactaagacaagcattttcctaaattcttaaatctgctgctgaattacaaacaatgggtaatattacacttgtaacatttgcccataatcaaattcctgccaatcctcttgactgtatcccttacagtccttacattgttgtaggcaaccatcaccatatatccttgcttatttgaaactgatgttttaccaagaaaccatttttctttcagttccttacagcacaggctactcattctcacatagttcatggttctctcatgaaccatgagagccgggagttaacaatggcctcctcttagttccctactgctgattttagggtattgcaatgccaaagcacttttccttgggtgctctgacacctggctattacatctcctgcttatctttgcatctgtgatctgcagaccttgtggtcattctaacacaatggctgtcaatattggctgcacattaaaattacctggaaagcttttgaaatctgcccttgcctacgtcctatttcaccaactaaatgtatttgaaggggtggagattgtaatccatatctagttttttaactggtttggtgatttcaatgtgaagccaaagttgagacctttgttctaacctaagaattaagtatgtcagctctttgttcatcagtttcctcttcatcctaactcttgctatcatcctggaatcttaatgttcaagagtacaacctgtccaacactctgggtcctagttccttgaccagttcaactctaataacatgttcctcaatttcacttcagcttttatacatactttatgaatttatcataacctgagctgcctgacatctgagatactaaataagcaaaagagtttatggccttgaactctatagttctagcttggtgactccttttccgtgtgatgctatgcctctacctgggccccggtagcttgctgtaaccttgtagaggagaacgtgctttctaactctgccaatcttctgattctacgtcctttccaaatggataatcctctatggtgcatcactctggtaattcttaccaattctatcaagtctctcaacctcttgtgttcctttcacattcacaactccaattatatattaaaccaaatctgccttctctactgctatgccctagatgctgagaagagactactgaagaagaaaaaatccaactgtagatttatgccacctccattcttatggtatccaaaagagcagctcccagaactactaagaaatctttttatatgtcctaaatgagcccctattttccttactcagatggttattattcttcttgtgctcctatctcactcctttgccactcgcattagaaatgaaccttgctttttgttttggagaacataaaaatatctttaatttctagacttcaaccctttattaacttatctgcatccctatccacacttacctgtttagaggggcactgctctaagctccatcctgttgacatttttggccagagaattctttgttgaggggagctgtcctctgcattctaggatactgagcaacatccatgacctctgcccaccagtattatcccccaccttgtagttgagaaaacaaaaaaacatctccaaacattgctaaatgactcctggatggcacaatcactctcacttgagaaccctctgcttggagcaagactgatctgtcaacctgtctttccaataaagtacttcctgcttcctccaagatccactgtgtccttggtgtcctttctttatctgtcttcaacctgaacctgtctattggctttgtctccttaatatataattttacatctgtccattatttaaaaaatcattcatggacaccagacctccctttagccactgaggaatctttttttattcttcaaagtgaaactttgagaatggcttccatgagagttcacatgctgaggcctcattccacctttactctgctctttaatccttgccactctattgataccggtacaaagctaccagggtcctcttgatgaccaaatgcttcgacaacctaactgcttggctgtttccaactatactcttcttgaacctctctacctcttctggcttccagggcacttttttctgtttattattttttctttttttccttttcctttattctttcttaattttctcttcctttgactgtcccttaatactagtgtttaattaggttctgtccttggccttctcctcttatagctctatgacatactttctgggctctgccttcattacaagcttccacttactgatataatagaactaacacactaattctcatttgattttgaagctctacattctctcaaattccaatcctgcatttctggctcccagtgaatatttctatctgggagcactacagatactactaacaaattgagatatctaaaactgagcttatcatatcttactctgcaaggaatggtgattccttttccctgtcttcccaaatctttcttatttatttcattacttctatggcaccactatttattcagttgtctaagacccttagcaaaatcctagattccaacttcactaataaaatccaatcaatcataaaatcctgtcaattacagcttatgtcccctgacctccatcccccctagttcaggtttttgtattttatttccatggattcctaatttccttgtgctaggtccttagctacctcaaattcagcaactattctgctgcactagaatgacctttctaacatgcaaatctgttcatgtcattccctgaattacgtccttcaggggatccccttcgtcaggagtataaaatttaagtgttttagtagagtatgctacgctcttctgtggcctggttcctggatttctcctgtacttctctctattagaacttatgcccagacataatcataccatcccataacttactcacgttattccctctgctggaaaggtttttctaacttcactgacctaacacatatttttgcatcctagatgcctcaggtcaagtatttcctccttgggaactcttcatggactcccccagggtatatttaagaggctttctttgtatgtgttcccaatatactgtgtacatatctgcattatagtttctaccagagtctactggacttgcttgcttgcaggtgtgtgcaccagcctgtaagcaacttaagggcaagtgccttgcctactcctgaaactcctgtttcagtggggattaatagagcgcatggatgaaggcattcaataaaacatgctgactgactgaatgatatacgtcaggttcaactgtcaaaaaactttattttgacactgtaatgatatgtacatgaaatgtatttgtaaaaaaaatctatgttggttcatggaatcaagaagcagtgaggttattcagtgtaagggaagagctaatttaatataataaaacaagtttagtaagcaatatacatgatagtacagtgcttattaaacctttctaccaaagtactgctaacaacagaagaatactgattaatatccctgaagggtctgatgacacagactaaaatacatgacatttctctggctactctggctggtaatacatccacattcattttaacgtaaaaacattttaaattatttgcaagtaaaaggaatgctccagaaagacagaacttcttaattttgtgaactccagtgagctctagcataaatgtttacctctcaggtggggctgatgacactgtcagtatcacagttaaagaaataagtgcagagtagaaacagcacacctaaagccacaagttctactttgggtccttgtcccatcacttaggctgtgacttggagtctactttaacctctctgggcctcctcagtttccttatctggaaaatggctataacgtttgccttatgtatttcataatgatgtttgtaccaagacataaaaaataatgtgaacaatgaaggataataagcataaaaaataaagtaatattttatccagagagagtgaaaatcaaagtacatatgtaatacgtatgctcaaaaacatttaccttttgaggagctggagatttttctattttagttttttcctcagggcttaaaggaggggatcgctcctttatctcaggaggcagttcttgatacagtgctgaaattggaaaaaggaattcatgtaatcaaattgaggagcactgctccatgggggaaaaacaacgatggtaggggcaaatatgaaattaaagaaatcgatattcaattccttggtgtaccaataagatacctaaaacttacttgttacggcaatttgcaattttactcattagttatcaaaagaactatgattggaaaattttaatcatctggatttcagaaatgcagaaggtgtcattttcacttattatctggtcagacagatgcttattttattttatctcaatacacatttaccagggacctgctaaatgccaggatatctgctaggaactgttggagaacatatggagatcatcaaaagatagtcttcattagcaaggagcttacagtctggtcagagaaagacatgtttacaagtaaccataaaataaatgtgacattatttgaaagtgaaataattacaaagacaaactctgatgtggggatggaaaatgcttaatggaagaagtggtaggtgtatcagactctgaagactaggtaggattttaccagtcagaggtacgcagaaaaactaatttgggggcagggcgcggtggctcatgccaacactttgggaggccgaggtgggcagatcccttgaggccaagagtttgagaccagcctggccaacatggtgaaaccccatccctacccaaaaatataataattagctgggcatggtggcgtgcacctgtagtcccagctttgggaggctgaggcatgggaattgtttgaacctgagaggtggaggttgcagtgagccaagacagcgccactgcactccagcctgggagacagggcgagactctgtctcaaaaaaaaggaaatgataatttgggaagacgatatgaaatcaataagcatggagttaggactatatatgatattgaatctatatacagtgttgaatttaagattcttacaatccaatattctatataatctattgaatctacatagggtattgaatctaaagagctatgtgcaaattttaaagggttaaaacaaaaatatattttggttaagaacatctctgaactgaaagaaattgctgagatatacttgatcaaaattgtacaactaagattatgagatatactaattgtctttgtatgtggagtgattttattattgggtttatctcatattttgagggtgttagatgtgatgggggaagctgatcatgttgttctttacagtgccttaagatacaaagagagtaagttccttgtaacagtgggagtacgaacttcttttattgtgttgttctcttagaggacaggctctcttagagtatctgcttgtatacttccttagattctgctcttatactcccttagataattcactttgcatagttggcttcagataaagatcaaggacaattcttcctactatttttagactagaatatgctactgacagtcatttttttctctaatgttaaaactgggcaattgagttttttgttaaattcaggtaaaaaaaggataaaagggaaagggaaataacccctaatgaagtgtgagagttcaatcattacagtcgcagatttttctaagttttttttttttgtttgttctggtctatacaaggctttttaaagcagtgactgatgccaaaagaaaacataaattattctgggatacaataaggaattatggcagttgaaagatggtcatcattgagacaaagaatttatttctgtacgtagccatcaactcatcactgcaatatgcttcagaggtctggctttgatcatcatggaagaagaacaaattttattagcttttaaaaaaaatttatcttttgtggagatggagtcttgttatattgcccaggctggtctcaaactcttggcgtcaagtgatcctccctcttcagcctcctgaagtgttgggattacaggtatgagctgctgcatctggcctcattagctttttaattcactgtagctcaaatatctatatcctctcaagatctgcaagcctaagaggttatttttgtaaactacattctcaaattaaagcacttaatcccaccctgcctagagatacacaagggagaaaatttaaaaaatatttccatttgtacatgaaaagagtaatggattgtaatatttcgttaaaatgaggcatactccagagtgactaccattgtgccagcagctcttgatttaaaaagcttgatttaaacagaagctactcctgtttaacctcagctgttgaccctgtgggagacccaacaatgagaagaaggaacttggctattttagatgatctggaagttagaagtgctgagcttatggaacttatatgctgtcttatacctacatgggaattaacttgccctaaaatttcttcctttcatacggcctatgttttttccattacacaacctcttctaaacacaaaaatatacctctaacagagtttaagagttatgtgtcaaaatcagctgggcatggtagcatgcccctgtagttccagctactcaggaggctgagatgggaggactgcttgagcccgggaggtcaaggctttagtgagccgtgactgcatcactgcactctagcctgggtgacaaagtgaggccccgtctcagaaaaaaaagaaagaaagaaaaaaaaagttatatgtcattcactacttacaagaaggtaactaaaacagctacacagaagacattaagaattttatgagagtgagaagtggtacaatttttgagacacatagaactttttaggggaggagtctgctgactgtggcagataaactgaagaagggagctgcaatgggacttagggcacttgagagactggggaggggagcaatgggaaggacctggctgaagacaaggtcgtgggaaggtgccaaagacagataattttatctaggcttagcccagcatccggtaatcacgaaggaaattcttccattccttcatctctttggctgtcaaaattgaaaacttaggttagaatcaataatatttttgtttagtcgtagttttgggttaaacagtttcatggactagcctgaaaaccaattattatttataataattatttctttgcagaaacaaaagacttaaatattcaaaacacagattgttctcaatttcaaggctgcctatactacaacttttttttcttttttttgagacagagttttgctctgttgctgggctggagtgcagtggcacgatcttggctcactgcaacctctgcctcccgggttcacgcgattctcccgcctcagcctcccaagtagctgggattataggtgcccaccaccacgcctggctcattttttgtattgttagtagagacaaggttttgccatgttggccaggctggtctcgaactcctgacctaaagtgatctgcctgcctcggcctcccaaagtgctgggattacaggcgtgagccacagtgcctggcccgcctatactacattttgaatcagaaccagaatttttgtgcttacagaagaaaagcttacagataatatcatttaattccttcattttacagaaggtaactggggcgtatgagtgtaagatgttgagctgaggttagaagtcagttttcctgacccctgagtgttgtgcttttcctagcatgctatcaagttaattgtggatagaatgcattcttctcaagaagcactactgtacttctcccctttaatgacagttttaagttattattatttttgttttcaggctctctgcgttcgttctgttttcacctctcaaggcctagtggtgaatctacagctttcagaaactcatatttagattttcttccctagctcttttttttttcattttaagctattatttaatgaacaaaaaccattattaaaacacgaagtagaaattaaaatacaagaaaggttcatacagtcttgtcacatcacatggtaagttctaggctttgtcaacacgtgcacataacttttaaataattgtcatttatcaactttgtgcttacatattttcagctctggctcattttttcccccataaatgagggctaaatttacttgagaatgaaacaacttattgtagttttgttttcacaggtaaccagataggactgaggtatacaaagtaaaagaatgcagttggggaactagaagctcttaagatgccagtcagctgaggaggcactgtggctagagaagaactgacagaactgtgcatgaggcaggtggcagggtcaaatgagttgaataagaaagctggtagctagaggggcagggtccccgaggataagaagtccatgaaacaaacattccaatctcagaatggagcagcttctaatgtactagtgcctcctctttttatttttttacatcatgagaatgaaaaacaatacccattggtaaacatatgcaaaggttacaaagacagtaaattaaagactagaaaatgataaaatcttggactatcagttataccatactagtaaaccaggaagggagcataaaacttactttcactagccacatgattagctggaaaataaccttcctgtccctttcctatgctgccataccaccagtcttcattatctttgaaaaacactcggataatgtctccgcgatggatggttagttcatctgatcgattcgctgtgtagtcataaagagccactacctaagagagagataagaccaccacagctttatcacaactgtaccacagagaaaacccccaacattcacttcctcttgcagaagagcagctgaaaccaaagcagtactttggtaagtgtgaggctgtctcaaggtttgctaatgggatgaggggtggtgggaacacagcaggagaagcaagataaaagactgtgggattgagaaatggttacgagcattcaatacactaagattagcttcaaaatagcagatgttaattttttaaagtaaattacttgtgaagcaaataaaaaaaagctcacacaccatttacttttttagaattgttttatactacctttatgtctcattctctgtgctaagcagatgcatctgaaaaaaaattcttcagaaggtctacagttttacaaaaaggaaaaactcaatggaacaatctgattgtattgcttggtttactgttaatgtctttttttgagataaatttctctacacacatacatattttttgatgttttatatcaacaacttaagccttctatctttaaaaagtatccatataagttatttttacttgatacgaatttaagaggaaaagccttttcatgagaatcctcttctttgtgttacaataatcattatatttgacttccttttcttttgaaaacccaagtcaaaatgatatggcagtggctgcacaggcatttaaaaatccttggctgggcatggtggctcatgcctgtagtctcagcactttgggaggccgaggcaggaggactgcttgaagccaagagttagagatcaacctgagcaacaaagccagacctccatctctatataaaaaaacaacaaaaaaaattagttggctgtggtagtgtgtgcctgcagtcctagcactcaggaggctgaggtgggaggatcacttgagccccagggtttggaggctgcagtgagctatgactgcactactacacttcagcctgggtgacgcaggaagaccttgtctctaaaaaaaaagaagaagaaaaaaatcccttatagtagttaaaggcaggaagacctcaattcattttagatttagatctgatacactgtataaagtaggacataataacatctatactaaataatacatttatgctgttttcccctctacttaaacagtatctgaaaatgtataggttatacaactacatatgtaatggaaaattacatatatagttatatatacatatatatatatatatatatatttatagcatgtctcagtgtgcacagcacgtgagagtccagggaagagaaacctaagagtcccatgtggtgggaacccggcattagacgtgagagctgagatagaaggttaggagaagctgaggctcatggagtaagcagggctcagatcatgcatgttgataaagttcagactcaataatatggccaatggaaaggcacagaaaggttttaaccagaggattccattacagttcacataactgtttctgataccttttaatccatttaacaatatttattaacacatcaggcaattctaacgaatgagtttggacttaactgctgtcaccatataagggcagtaatgataatttaattcaactggctcaaatgcaatgcctattgtacagcttagcatagtatctaatttacaacatgcgatgcagggtgttatttaaggtttacaaattacaatttttttttttttttttgagatggagtctggctctgtcgcccaggctggagtgcactggtgtgatctacactcactgcaacctccgccacccgggttcaagcgattctcctgcctcagcctcctgagtagttgggattacaggcgcccaccaccgcgcctggctaatttttgtatttttagtagagacggggtttctccatgttggtcaggttggtttcgaactcctgacctcaggtgatctgctcgccttggcctcccaaagtgctgggattacaggcgtgagccactgcgtccggccacaagttataattttagtatactgatgttaagtcacttacatacaagcggaactttaacttttctctttgttctccaaatttctctttcagtctcttacctggtactatcataggagaggaaagctaattaaaatgtgctgagtgctcaccatgttctcgataccatgctagctgtttaggtgttattctgcttaatccttatgacaacttggtcaggccatgtatctttatttccattttacaaaagaggtatttgatgtccagagaaatttaggaacttctctaaagtcaagtaaactagtaagtgatagaatcaagacttaaacccagtctcaatctctttccttccttcccttctttctttctcttcccctagttccaggaaactctgtgatggtttgttcctgttgttccttatcctgggtgtggtacaaaacacaactttaatgagtctcatgcaaagatgagattaatgtatgcttatttgtctggagccctaggtggctgctgggaaggattcagcttaggcaacagaatcacttacgaaatcctacatcaggctgtgtcactgtgtgaacctcggaaagtctgaagcttatcaagtgaagtctgaaaaattttcctgaattttacacacaggggtgtcttgataaaagaatcccttcagaggcacaggggtccaaaaagcctatgagagcccacattacaccttttctattacagtacctactgattattctcttacagaaccaaatacacacatcaattttgcatggcccactagtatctgtaaacatgttctgcattctgtgactgttatggactgaattgtgtcactcaaaattcataggttgaagtcctagctcccaatgtgaatgtatttgaagacatggcctttacggaggtaattcatgttaaatgaaatcataggggtggggcctggattaacaggactggcatttttataagaggaagatacagtgagaaagtggccatctgcaagccagcaggagaggcagtaggagaaaccgactgtgctagcaccttgatcttggtcttctagcctccagaattgtgagaaaataaatttcttcttcttcttcttttttaaaaaaattatttcaatagctttaggggtacaagtggtttctggttacatggatgaattgtacagtggtgaagtctgggctttcagtgtacctgtcatgtaaatagtatacactgtaccccacaggtaatttttttttttttgagacagagtcttgctctcttgcccaggctggagtgcagtggcgccatctcggctcactgcaacctctgcctcccgggttcaagctattctcctgccttggcctcctgagtagctgggattacaggcacccgccaccatgctcagccaatttttgtatttgaggtagagatggggtttcaccacgttggccaggctgtctcaaactcctgacctcaggtgatccgcctgccttggcctcccaaagtgctgggattacagacgtgaaccactgcacctggcccccgacaggtaatttttcattcttcatccctctcccaccctccttccactcttctgactctccaatgtccattatacctctctgtatgcctttgtgtagcttagctcctacttttaagtgagaacacgtagtatttggttttttgttcgtgagttacttcacttaggataatggtcccattcccatacaggttgctgcaaaatacattatttcatactttttaaaatggatgagtagcagtcgacatacatatacataacacactgagaaaataaatttctgcaaaaccacccagtctgtggtattttgttagggcagccctagcaggctagtacacttttaaacctgatggtgtcagatgaaccacttactaccaccccagcctaaaactacaaatgtgtaatgcctcacttgtatccatttcaggtcctcagcaacttacagaaccgttttccacactattaagctgtcatctccggatgtagaaatgtctttgtcataaaactctacaaccagcatccttgggagggtgatgactggtgaggctacgttctctaaagcaaagaaattggagcatgtcatcgtaataccattgttgacattcaagtacacgcagacctcattttattgtatttcacagtgtggtgttataatatgtattatgtttctgtttgcaggtcctggttcataactcccatatcccttgttacagttttttggtttaatggtgggtatgttaggccttaggggcaggcctcagaaaacagaatgtctctgatctccttctgctctccttttacctgccccaaggtagggctctaatcaccaccccctacctttctgactgtaggtcttatgagcaatcagagggtccttcccccctctaccctggaggaaggaatgctgatgtcgcggagcttccacaaaaacctaagaggactgggttagcagagcttccaaatagctgaacaaatggaggttccaggagagtcatgccccagggaggtcaaagaagcttcccctccttccttcatagatcgctctacgtatctcttcatctgtttcctttgcaacatgccttgtaataaatcagtaaatataagtaagtgtttccctgagttccatgagttactccagcaaattaagtgaactggaagagggggttgtgggaaccccaacttgaagccggttggtcaaaagttctggaagcctgtacttgtgaatggtgcctggggtggggggcagtcttggggactgagccctcaacctgtgggatccgacactgtcttcaagtagagggtactagaattgaattggagtacatctagctggtcatggaagtcttctgtgttaattgtggtgtgagaacacagtgaaaacatggttggaaagtttttcccaaacatgtagatactgcatttttttgccaactgaaggtttgtggcaaccctgcattgagcaagtctatcaaggccatttttttccaacagcatgtgcttacttgtgtctgtgtgtcatattctggtaattcttacaacagttcaaatttttcctttattattatatctgttatggtgatctatgataggtgatctttgatgctaccaatgtaattcttttggggtgccataaaccatagccatagaagacaataacttaattgataaatgttgtgtatgttttgattgcttcaccaaccaacctccaccctcttaccccctaccaccaggtctctctccccttctccttgggcttcctattccctgagatataatggtattgaaattaggccaattaataactctataatggcccctaagtgttcaaatgaaaagagttgcaagtccttcattttaaataaaaaactagaaatgattaagtttagtgaggaagggatgtagaaagctgatagaagcaaaaaactggcattttgtgccaaacagtcaagttatgaatacaaaggaaaagttcttgaaggaaattaaaagtgctactccagtgaacacatgaatgataagaaagcaaaacagccttattgctgatatggaagttttagtggtctggatagaagatcaaacaagccacaacattctcttaagccaaaatccaattcagagcaaagccttaactctcttcaattctatgaaggctgagaaacgtgaggaagctacagaagaaaagttggaagctagcagaggttgcttcatgaagtgtgaagaaagaagccatctccgtaacataaaagtgcaaggtgaagctgcaagtgctgaggtacaagctgcagcaagttatccagctctaggtaagatcactaatgaaggtggctatactaaagaatagattttctcaatggagatttaaacagacttatattggaagaagatgccgtctatgactttcatagctagagaggagaagtcaatgactggcttaaaagcttcaaagaacaggctgactctcctgctaggaactaatacagctggtgacttcaagttgaagccagtgttcatttgccatttcaaaaatcccagagcccttaagaattatgttaaatctactctgtctctcctctataaatggaagaacaaatctagatgatagcccatccatctacagcacagtttaatgaatattttaagccctactgctttgtgaccttctgctcagaaaaaaagattcctttcaaaatattacttctcactggtctaccaaagagctctgatggagatgcacaaggagataaatgttgttttcatgccagctacaacaacaaccattctgcagcccatggatcaaggagtagttttgactttcaggttttgttatttaagaaatgtatttcttaagtccatagctgacatagacagtgattcctctgatgaatacgagcaagtaagttgaaaaccttctggaaaggatgcactattctagatgacattaagaagatttgtgattcataggaggacatccaattgtcaacattaacaggggtgtggaaggtttattctgaccctcatggatgactctgagggttttaagacttcagtggaggaagtaactggagatttggtggaaacagcaagaaaactagaattagaagtggagcctgaacacgtgactgaattgctgcaatctcatgataaaacgaatggataaagagttctttcttatggatgaacaaagaaagtggtttcttcagatggaatctactcctcgtgaagatgctgtgactcttgctgaaataacagaggatttagaatatcacataaatttagttgataaagcagcagcagggtttgagagtactgaatccaattctcaaagttttactttgggtaaaatgctatcagacagcactacatgctacagagaaatcttttgtgaaaggaagagtcaatcgatgtggcaaatttcatttttgtcttattttaagaaattgccacagtcaccacaaccttcagcaactatcagtctggtcagtcagctgccatcaacactgaggcaagacctgcctccagtaaaaagatgacttgctgaaggctgagatgatcattggtattttttagcaatcaagtatttttttcactaacgtatgtacactgatcatttagacatggtgctactacatacttaatagactacagtaaacatagttttaaacatagttttctatgtactgagaaacccccaaatttgtgtggcttgtttcactgtgatattcacggtattgcagtggtctggaaccaaaccggcaatatcttcaaggtatgactgtacagaattgctacgcaatgaggaatcagggtggtttcacatgctaccatctgtccacatgccggcagccgaatctaaccattcagttaggattattcccttaacacactgaaggacaaaaacagcgtggctcacgggaatctgcttgtatttcagcgtttttatccaatgtgctgtgaacttctcatatgaagatcacttactgtcttctgatcatcatattgtatgtagtaaacttctttgcttgtgttaatttggcagtggattgtgagtaaatcataacttccctatgtccaattagattttattatttcaatattttataataaattaaagttctataaagcagttaggtggcacagtcctatccagaggtttgttctgaagtaacagtctattttctccttgttcagtcaggcatcactatagaaatatctttcttgaccattcttttgatgagtgtcttttataacataccatttcttgcaccctgtggtttggcatgtaggagaatatcttcagcaatatgactcaaatcttgagctgacagagtaattaagaaatctttctgtgacagaagtttaaagacacgagctaatatgtccatcttggtaatgacaggactagaaaaagagatgtttcacaaaatccacgtggtcaaattttgaccactgttcacatatttgaaatagagttcttctttttctcaaagcttgaggggttgcttggtcataatcatggtctcagtgtcactggattggcaagttttgtttttttgacacactattttcactcttttccagcactgctggaaacaccatttcttgatttaggcagagtctgccaggctgttgtaagacattaggggaattcctttctgtattatctttcaagggattaaatattattatagtggtctctgaagaattctcagtgacgcctggtcaatgaaaccagtgtactgagggaacaccaaccagtagagttcagcagcatagctgttccttacagttttatccacaatgcaatccaataattgatgttcgtaatacctccaagtcattcgacaagctaagcactgaataaattcacacgcttgagcactttttccttcagccctacttcaattgggcccataatcatttgggaacttctctgtgccagtctaataaggcaatatggcatctggatcccaccaccttctttatgctttctccttgactaacctgatttcagactccgggcttccagaactgtgaatgaataaatgtcttaggttttaagccaccaagtttgtggtagtttgctacaacagccctaggaaactaatagacacgatttttactttggtgagtgctggattttcttctatttctttaaagagtgttggaccttggtctggcatgccattacttgatatccgttttcaggtttaggtttttttttttttttttcagacggagtctcactctgtcacccaggctggagtgcagtggtgcagtcttggctcactgcaacctccgtctcccgggttcaagcgattttcctgcctcagcctcctgagtagctgggattacaggcgtgcaccactatgcccagctaatttttgtatttttagtagagatggggtttcaccacgttggtcaggctggtctcgatctcctgacctcgtgatctgcctgcctcggcttccaaagtgttgggattacaggcgtaagccaccgctcctggcccaggtttaggttttgatagagcatattcagagaagactttactctagggataaattaaccccactatcaaggtgtgaccttcctgatgattctacctgatgccccaggtatattgaatattgaataaaaattacaagccattggactaagctcctgaactaggccccaacagaccagactaacaatcaaaatgaagtcactcgtgctgaagttctatgtcatcaaaccaaaactaacttgttaattcaccttccaagaaattgggagagaaagagagccaacttcccaaacaggccagtttaaatttccaaccagtatggtaatgaagctccctctgttttaatcttgacaacaaaaagtaacctgaagttaaccagttattcttctgttattctgttttccttttcctgatatacaaggaaaggaactttaaaaaaccaatctgctctttattctttgtttctccccccgttccttctctgtctataaaaccaacttcttttgctcagctcactggaacatatattctattttatggaatgaaatgctgccccattctggcaaataagccaattaagatctttaaatgtattataattttgtcttctgacagaaggtttatcattctggctatcagaaatgcgaatttttgccatcctgttgttgtgtcttctactctctgatggtccttttcttacgaagttttgctccacacatgtgcagatcagcactcagccaaagacttcagggtactccttaggattactggtacaattattaccatttaatatagagccaaatataaagtaatattttagtaattatttaaaaagtgaaataaaatacgctttaagaaagtctcatttctcaataatgtcaaagataaaaaatatttgtagaaaaccaaatttaacaataaatcctgaattgtacagaagcacattattaaatattaaaatgcttcctttactaatagtgacactaggactatattttatttcataagaggaataaagaaacatatagccctatttctagcatcatgtggtagaaacatacagtcccttaccattatatccagggacaaccctaaagatatttataaaaaagaaatcaaggtcctattatttttaactgatcttatctggataataatagattaagaaaacaaagataaagaaagtaaataattgcacacagtttattgcctctgtatcagataaatgatctgttcctatcttgctgtataatgcaacgataagtgaaacttaaaaacttcaaacaagcatttgaaagcatttaattccagatatcttctgataaaataatgactaaaggtgttggaaagaataccaaactagaaatcaagagaatgagtttccagtcctgtgtaggcctccaaggtttaagtactcagattatatatctgtaaaataagaggtctagacaagatgatatatggtataccttccagctttaaaattttaccaaactaagtactcaattatatcaaaagaacagcattcatagattttaaggtaaattgaaaatattaatttattggataacatcatagctttattgtttgtgatcacacattaactgaaaaagcttttgtctgattgctgcaataatatataggaaaagcctcttagtaatattagacaacaataacgataaagcatttcctctgaattcaccatttggaaatacttttcttattctttgacaaatagggatgactttccaagttagactgaacttgacctttgggcttcaaaaataaagctactttacatgtgaaagctcatttttatatgatggtgatatcatctgaatgtttgtgcccctcaaattcatatgttgaaacttaatcatcgatgtgatgatggggcctttgggaggtgattaggtcatgaaggcaggaatggaattaaagcccttacaaaagaaaccccagagagcttccctgccctttccacttgtgaagacacagcatgatgatgtcatctatgaaccaggaaatgagccctcatcagacatcaaatctgccagtcccttgagcttggacttcccagtctccagaaatgtgagaaataaacttcagtcatttataagtcactcggtctatggtattttgttacagcagcccaaacagactaagacaattggtatgaattaaaccttttcttactgcgaatcacaattcacatactttattataagaaataatcggtattacattgaaaaagtttctaaaataacatctttttattggctattccctaaaaataaatcaagagaattctgcagacctttatacattggactacagatttgttaagagaagaaaaaatcatagtgtattttcattttctttcttgggagggataatctgctcactataaaaagaaaattatgaatcactgatttagattagggttctcaaaacgtattccccagacctgcagcagcaacatcacctggaaacttgttagaaatgtaaattcttgggccctattccaaatcaagtgcatcataaattctggggatggcccagtaatctgtgttttagcaagtctttcagcaattctgatgtacctaacgtttagttaatactttattttactggtctactttataagacatatatacttatttctgcacatatcaagtagtaactgaatgggtaagaaagataatttaaaatataaagtcgaatcttagaatgttactggccaaacttacgaaattaacctactcttgctttctgagttattagctttacttatcttgcttagtttcccacatgtcacactgaaatgctcactagctccagatttggtcaatttaacatctactttgtcattttttttcaacaatcttatgctcaaactgcaactaggagtatagtatataatttttaggtttccttacaatctcttaaagattagccaaattttaaaatagaaaaatatgcaaactttaaaaattgaatctgttcatccaacaacaatcatcagttacctattatcaaatctcttacaggctaaggagagaataatgaataaaagaaatttaaaaaaaaaaaccactctcagagagcttccattttttgggatgttacattgtatttggtttggtattccttttcaaaaaaaagggtacctctaacatttgtacaagttactcttctgtttttctacttttatgttgctaataaatagtaccaaggtgcatgcagatatataatattaaaataataatttgtgcatgaattatttcagaaaagtataatgaattattttaaattctcttaatgaactgtaagctgtaagcaaatgtaaaattactagtaatagacacagacaatatttttaaatgagaataaatccaagtatttgtaaataacatcctactcatgatttacagatacagtttcattagttataaaacattttagaaatatataaacaggaccggcgtggtggctcacgcctgtaatcccaacctaggtgggtggatcacctgaggtcaggagtttgagaccagcctggccaacatggtgaaaccccatctctactaaaaatagaaaaattagctgggcgtggtggagcacgcctgtagtcccagctactcaggaggctgaggcaggagaatcacttgaacccaggaggcagaggttgtagtgagccaagatcgcaccactgcactgcaccctggatgactagagcgaaactccgtctaaaaaaaaaaaaaaaaaaaaaaaattccatatttataaatacagacatacactacataataacatttcagtcaatgacgtactgcatatatgacagtggtcccatatgataatggagctgaaaaattcctattgccttcttacattatagctgtcataatgtcacagcacaattaatttttaaataaatttagtgtagcctgggctgggggtggtggctcacacttgtaaatcccagcactctgggaggctgaggtgggcggatcgcttgagtccaggagttcgagacaagcctagacaacatggtgaaaccctgtctctactaaaaatacaaaaattaaccaggcatggtgatgcatgcctgtagtcccagctacttgggaggctgaggcaggaggatagcttgagccctggaagtcgaggctgcagtgagctgagatcatgccactgcactccagcctagatgacaaagtgagaccctgcctttacaataatctcctgtatcttatgagatattctgtttcttaaacatctcatttagatgctttaattttattcaaccaaggttttagaactcattagctctaaaacaatcatacagacctcagttgggttttctctcagcattgatgttcatttactgttactattaatcatctgatacattatagacatgcctgtgtatctgtctagatatatttaggaatataggtatctaccatttacttaatgcttgctatgtgtcaggaaggtgttaaccattttatactatacatatatgtgtgtgcacatatacacacacacatacacatatattcataactaccccatttagtatttatcatgccttagtttccttaactataaactaaaataactgttatttttaagttacacagtttagcagaatagagatgtaagcaagtctgcttttctcccacgtctatgctcttcttaatcactagacttacattataagccctcatggaaccatgggaacacaaacctgcttggttcactgcttgtcactttccttaaaattatgccaaaaaaaaagggtcttaaagacttggcatttctttattaataatgaagacacctgaagaagatcaacaaagtacttttcttcatactaatttctcactcacaatttgttgaggccaccaaacaagcaagctacatgggaaattgaaattagaccaaggtggcagcatacatgtaccacatacacatatatgtatatattaacatacatacatatgtacacattaacatttctgtccatttggttactgaagttggtatttagggtgcaggaaattactaaaatgatagaagaaagttactgtggaaaggctgtgaagaggccaagtgcagtggctcatgcctgtaatctcagcactttgggaggtcaaggagggaggatcacctgagcccaggagtttgagaccaacctgggcaacaaagtgagacccctatctctacaaaaaaattaaaaaaatcagctaggtgtggtggtgtgcatctgcagtcccagctactcaggaggctgaggtaggaggactgcttgaacccaggaggtcaaggctgcagtgagccgtgatgatgttgctactgcactccagcctgggttacagagtgagattctgtctcaaaaagaaaaaaaaaaaaaaaaggctgtgaagaaatcttgagtactaaaattaaatgagaaagaggatagccagatatcagtaattaactgcttattttactaaaataccgaggcttatctaattccaaagtcaatccaaatattctaggagaagttcgcgtacatgcatatgagcatttggtttatggggaagaagataaggatataataagagaaaggataatgaagaagcatagtagaaaacatccctggctgggcgcggtggctcacgcctgtaatcccagcactttcggaggccgaggtgggtggatcacctgaggtcaggagttcgagaccagcctggccaacgtggtgaagccctgtctctactaataatacaaaaaaaattagccggcatggtggcgcacacctgtaatcccagctactcgggaagctgaggcaggagaatcacttgaacctgggaggcggaggttgcagtgagctgagatcgcaccactgaactccagcctgggtgacaagggtgaaactccatctcaaaaaaaaaaaaaaaaaaagaaagaaaaagaaaagagaaatatccctgcgttagcacgttagcatataattctaattgtgatacataaggaaatgtagacagttgattaggggactctaaaacttatcaaaaagcattttcaatggctaaatagaaagtagcaaatagaatcttcagaaacaaatggaaaactctgagcttaaggataaatgagtaaaggggaatcacttccagaacagtgaagcagtgaaatgggctcctccaacaatgcaagaacactgggattaactgtcaaaatcaactttatcagaactctgaaaactaactaaaggcttgcaataatctcaggagtgtgattttaagaataacagccaaataacagtaaaaacagcaagctttgtggaattttaattttctctattcttatcatccccttgccaactccgtggtatccttacaagtcaacaatctcacaactatggctgctgtgaaaactagcagcctagcagttactagacagggcagaatgggtctggagcacctctaaaacccaatcgcaaagaaatgtcactttatgacctgtgtagcagctccctgaaaagctccattcccagagctcatctttccttttttttttttttttgagacccagagtctcactctgttgcccagactggagcgcagtggtgcaatctcggctcactgcaacctctgcctaccgggttcaagtgatcctcctgcctcagcctcccaagtagctgggattacagatgcccaccaccatgtcccagggctcatctttttaagatgtgactcacagcatgctgtgaatgattatatccctagggcatttgtcaaaagcaattaatggtaactgtttaacactgcacctgccttaggtggtgatatgagttaggactagagaaattaatttccagtttgccacattatataatctcaaatatcctcttatcaaaaaattacgaaacatgcaaggaaagaggaaagtatgtctccatatggaggcaaaatagttaacagaattgcttctgagaaagcccagatgttggacttactagacaaatattttaaatactattataagtatgttcaaagacctaaaggaaaccttgtctaaagaattaagagaaagtatacatgtacctcaccaaacaaacaaacaaaaaatcaatatagagatataattttaaaaaacaagtgaaattctgcagttgaaaagaacaatattcactagagggactcaatagtaggtataaactggcagaagaatcagtaaacttgaagataagtaaattgagatgatttagtctgaggaacagaaggaaaatagaatgaacaaaaatgaacagagcctcagagaattataggatgccatcaaatgtaccaacatatgcataacaggactcccagaagaagagtcagagaaaggggaaaaatgaccccaaacttcccaaagttgatggaaaacattaatctgcacattgacaagctaaatcaactccaagtagaatagattaaaaaagatccatatctagacaaatcatggtcaaatgactgaaggccaaagataggatctcaaaagcaacaagaataaaaaactcatcacacagaagtgattctcaataagattaacagtagatatctcataaaaaaatgtgaaggccagaagttagcgggatgatgcttttgatattgtgttgaaagcagactcaaccaagagttcaaaccatccagcaaaacactcctttaaaaaaagaaaaaaggaaggggccaggtgccgtggctcacgcctgtaatcccagaactttgggaggctgaggcgggtggatcatgaggtcaggagttcaagaccagcctgaccaacacggtgaaaccctgtatctactaaaaatacaaaaaaattagctgggcgtggtggcacatgcctgtaatctcagctactgaggaggctgaggcaggcgaattgcctgaacctgggaggtggaggttgcggtaagctgagatcgcaccgtgcactccatcctgggcgacagagcgagactctgtctcaaaaaacaaaaaccaaaacaaaaacaaacaaaaaaaaaaggaaggataagcagtgtcctgggttactgaaaaaataaattaaaaaaaggtgaaataaatacattgcaagataactgataattcagagagtttgttgcttgtggacctgcccttcaagaaaaacagaagtccttcggactgaaatgaaagagcactgacagtaactaaaatccatttaaagaaataaagaacactgataaaggtaactacacaaaatataaaaaccagtacatatatatacatacatacatatatatatatatatatatatatatatatatatatatgtttttgtttgtaattcttttctctccatctaattaaaaaaaactttgtaaagaaatagttataaaaataagttggtgggcttaaaatgtataaagatgtaatttgtataaaaccagcacaaaggaggcagaagggaaatgaactatcttggagcaaagtttttatatactactgaaattaacttggtattaatccaaactagattgttttgagatgttaattgtaattctaagggcaaacactgaaaaaactcaagaaaatatactaaagggaaaagaaaattaaaattatatagtaaaaaaatactaatttaatgcccaaaagtgagtaacggtgaaacaaaggaaaaacaacaacgataatatatcagacatataaaactccaaaaccaaattgtagacatcatcctatcttatcagtaatttcactaagtgtaaatagattaaacactccaaataaaaagcagagattatcagaatggataaaataaataatccaattacaagctatgtacaagaacacttcagatttaaggatacaagactgttgaaaaatggaaaaagacataccatgcaaatggaaatcaaaagagaactggagtggctattctaatatcaggcaaaatagactttaagacaaaaactcactcactagagacaaagaaggacattgtataataataaaagggtcaaccaatcaggaagacttaaaaagtataaacatataagtacatgatacagtctcaaaataaagatcaacataaaaatagaagatttaatcaatgctgtaatagatgtctataggatgcttcacttaacaaaagcagaatacatattcttgtccacagaacattctctaggagacaatatgttaggcccccaaataaaacttatttaaataaataaattttaaaaacctgaaagcacagaaagtatgttctccaaccatgataaactgaaaaagaaatcattcacagaaaatttcataatgtatggaacgtaaacaacatactccaaataaccactgggtccaaaaataaaaccccagggaaattacaagagaataaatgaaaagaaaaacacgataccaatatgtatggggtgtagaaaaagcagtaatttgatgaaattttatagctgtaaatgtttttattaagagaaaaagatatcaagtgaatatttttactctgtaccttaaaattgttaaataaaaattaaacccaaaggaagcagagggaaaaaaatttagagtggaaataaataaaacaacaaatagaaaaagagtagagaaaattagtgaaataaaaattggttcttcgaaagatcaagaaaattgacagagcttcaaatagactggccagggtagaaaaaacaaaaggtaagatccaaattaataaaatcaggaatgaaagaagaagtatcattaactactttagggaaatgaaatggattataaggaaatgaactatcaattgtatgttaacaaatcaaatagcttatatgaaagggacaaaaaaatcctagaaagatgcaacttaaaactgactgaagaagagagaaaatgtgaataggccaataaagagattaaaccagcaatcaaaacactgcccagaatgcatcattggtgaattgtaccaaatgtttaaacaaataccaatccttcacaaacttccctaaaataagatagaaatgaacattttctaattcattccatgggatcggtattaccatgatcccaaaaccagacaagaaaattacagatcaatgtcccttatgaatactgatgcaaaaccctcaaaaatataccaataaacagaatcaacatatgaaaaagattatattatacatcataacaagtgggatttgtcaagggaatgacaggttggcttaacatatgaaaatctaccaatgtaacagaccatattaatagtattaaaggtaagatccacagaacaaactcagtagatatggaaaatcatttaataaaatttaacatcatttcctaagaaaaacactcaacaaaagtaagaacacaaggaaatgtcctcaacctgataatatataataacctgatatatagcctataaaggctatatataggctacacacacacacatacataacagcatagctaatttcataattaatggtaaaagactgacagtttaccttctaagattaggaaaaagacagggacattcataccacttcaacattgtactggaggttctaactggaaaaattaggcaagaaaaaaaaaaggcacccggatcggaaaggagaagtaaaactatctctattagtagagtatgcagacaatctcaaagaactgatccccccaacaaaatctgaaaaaaaacaaaccccagaaaaacctgttagaatatacagattcaaaaaggtctcaggatacatgagcaatatacaaaaaaccacttgtctttctatacccaagcaacaaacatctttacctgagtaatgaacaatctgaacataacaccaattccatttgcaatggcatacaaataaatttaacaaaaaaaatgctgaaaaccacaaaacaccattgaaaaaatttaaacagacctaaataaatggacccatgctaaaagactgggaagacttaatgttttcacaatttaatctatgaattcaatgcaattcccataaaaaattttgcaaaggctgagaaggtgatcataagattcctatggaaatgcaagggatctaaaataaccaaaacaatctcgaaaaagaacaaggttgaaggacacaccctgattttaaaacttctacagatacagtaattaaaaccgtgtaatgctgaccatagaataggcgtgtgtatggatcaatgcaaaaaaattcagactctaaatataaactcttacatttttggtcacctgattttcaacaagggtgccaagaccattaaaaggaaaaaaaaaaaacaccaaaaaacaaactaacaaaaaacccccacttttttcaacaacagctaaatgcgaaagaataaagttggatccttaactcacaccatctacaaaaataaagtcaaactggattacagaccttaaaggtaacagctaaatatataaagccctcataagaaaatctgagagtcaatcttcagatcaggcaatggtttcttagatataacatcataggtataagtgacaaaataaaaaagtaaactaaactttatcaaaatctaaaaaattttgtgtgtcaaaggatatgatcaagaaagagaaaagacaacctacagaatggaagaaaatatttgcaaatcatatacagtcaaccttcggtacccttggaggattggttccaggattccccttggacaacaaaatctgtggatgttcaagtcccttatataaaatagtatttgcatacaacttacacaatcctcccatacactttaatctccagatttataatacctaatacaatgtaaatgctatacaaatagttgttatactatttttattttcaaattgttattttttttcaaatgttttccatttgtagttggctgaatctgtgaatgcagaacctacagacacggagggctaaatgtatctagtaagagacgtgtatccagactatacaaataactcttacaagtcaataataaacaggttaacttaattagctacaaataatataaatatatttacattaaaaatttatatatattttacaaaattttacaatttatttttatatactatataggtatatttatatactatatgcctggtacatattaagtactcaataagagttaggtataattattattaaattcctaagttatttgactattaacaaggaatgatgttttctgcagaatgcctatagctatgtgaccatattttccaaaccaaatatagatttgttaacttcaaaccctccctccctcccttcctccctcccttcctttcttccttccttcttccctccctctctcttccttcctttccttttctttctttttctttctctctctttctttccttttctttctttcccttcctttctcctttcctttctctctctctctctttctttttagaattacaggagaatccataaagtgaaagcaagtttattaggaaagtaaaggaataaagaatggctactccacaggcagagcaagcctacttcaactccatttctgaaaaccaaaaattatttctcagtttattgaaataagctctgattcacacacacacacacacacacacacacacagtatattaaaaaaatctagtatacataattatataacaaaacataattataatctccccaattagaaaatgagcaaagaatttgaattagacatttctccaaagaaaacatacaaatgtcatttcagaagatgctcacattatcgtcactgggaaatgcaaatgaaaatcatgaggtgtcacttcctatccactaggacagctataatacaaaatcagtaacaagttacgatgtggggacactgcaacactcattcatgtctggtgtgatcgtaaagtggttcagttgctttggaaaacattttgacagttcctcagaaggttaaacagagttaccatatgatgcggcaattctactcctaaatatatacacccaagagaatggaaaacttacgtccatgcaaaaacctgtacatgaatgctcacagagtaatattcatggtagctaaaaatggaaacaacccaaatgtccatcagtgaattaatggataaaaaatgtagcatatccatatacttgataatatttttggtcatcaaaaggaatgaaattctgatacatgccacaacatggatgaaccttgaaaacattacggtaagtgaaaaaagacagacacaaaaggctacacagtgcgtttatataaaatatccagaataggcaaacccatagagatggaaagttgattagtagttgttaggggtgaagaaatggaaaggatcattgctaatgagtacgggatttcttctgggggggcaacgaatgttttaaaattagatagaggtgatggctgcaaaactataaatatattaaaacccactgaatggtacactttaaaagggtgcattttatgccatgtgaattatatccaaataaagctgttataaaaaaagaacatcatggaaatgattgttaaaggaagtgtagttggttatgatgaagaaagaaacagtgcaagaaaaaatacacgtaaggagaccatatttctccatgtcagagaagacaaccttgattctggccatggaaatggacaaaagaggtgagactgtggaaatataatcaaaggagaaagcaacatctgtgggatataagagaactagctaagcttaacatattacaccaaagtattgctcataagaccaaacagctggtagtaccaatgacagaaaactaaagtggaaaggcccagtgaaggtcctggggaagacaggagttttactgagctgtgcttatttttatttttatttatttatttattttttgagacggagtctcactttgttgcccaggctggagtgcagtggcgcgatcttggctcactgcaagctccacctcccgggttcacgccattttcctgcctcaccctcccgagtagctgggactacaggtgctcgccaccatgcccggctaattttttttatttttatttttagtagagacggggtctcagtgtgttagccaggctggtctcgatctcctgacctcgtgatctgcccacctcggcatcccaaagtgctgggattacaggcgtgagccatcatgcctggccaagctgtgcttatttttaggttctttaaattaccaagtggtaacagtctaagtatggattataaagattttttttctagtaaaagagaaagaaaagaattaagattagaatatgagctggacagtcattcatgcttgaacatgagctgaaacttaagtgtatacagtgagcttaccaagtaggtctcaaggaagagatgaagcagccccatcacctcattcttgggggatacaaacaatcacctcctcattccttcactccttttcttcaagcagctgtctgtggcatgtgggtagcctagtttgaagtatagcaggtgtttgtaatttcctttctcaaggtcacaggtgactctgccagtgcacttcaaaaaccacagcttctgggcccctttcttcccaccaaaccccaagatccccttctcacatccagattactctgttacttacacatctttaacccactccacagctattagaattgaagtgcccctcttcccaggaaattgactaaggttctatccactagcctcagatcgttatctgtttgaaacttctttgtgggctgatggaatgttttccaagaaatgttttagaaattggctttcttagataatttccatggtggatttattaagaaggaggaaatcaaggtcatctgttctttttagctgccattctggtcagcctttccagtggtgcctgttgtctccaaccttcattatcacattccctgcctaatcccattgaaagttacagttatattacaaagatcagatgagataatatatagtatgtagcagggcttttaaaaatatacattgtttcatacatgttaactgctgttaatactacctaaactgctctcaattttcacaaaatttgccttgtgccactgaatgacattagagtttaatggtttattcagataaactgattctgcttttagagagttaatatttttggctcatttatcataatgaattaacatattaaatctaaatggttctagaagacgcttgaagaccttttttctgttttccctttggcaaacggtgatgataataataatttatctcatagaattattatgacattcaagtgagattatctgctttgcacagtgcatagtaggtgcccaataaatgttaggtacaattattattcaattcctgaagttcttcaaattatcatagaggaaaggtgttttgtagcgaaatatttctgtagaacacccacagctataaatgtgatcatattttctaaatcaaatgcagatcgactaactggaattcctctgctgaaaaccaggatttattttcagatttggtaaaataagctctgaagccaaaaagtactcccagagaagtctgcatatgttgccataagatagtgccagccagagagattctgacaagaaaactttatgaagtttgatttaaactacagaataagaagggttttttccccctctacggatttattttacttaatctttatgcatctagctaatctgtgacccaattatgtagttataccaagggtgtctgtgttagtgacggccgtgtggctatctctgtcaaagactaatctcactgctggggacactgagatgacaggatagagtatcacaagaagatgaaacttggtgaactcacatgtttatcacggtaaaaaaacaatctatggaacattagtagtggcagatggtagatgtccatctaggcaggaaaaccagggtactagcagtttgataacctttgattaaatttctccccaaatggaaagtaatgctccataataatgtgtgttaaattttttcttttccaaataattgtttccttcatttcatagcctgttaactcaaggtttgcttcctgctagtgactatattactgcttccttagagtggttaaattttattttccttttggtaaaggaaaattttaagtaaccactatatcttattttaaaggcatgcagtaaatgctttgttaaagcacaataaacactgaaattactattaagtagtaacactcctcatgcaaaattacttaaaaataaaaacttaaattgcctgcaggaaaaaaaattgttgccattttgattttgtgcactgtttaacatttttctcatgtttttgaataaagaaaacttgtatgaggcattataaaactcgttaatgctacaaagtttggaaggcagctattaacacagttgaaaaaatcaagattcaaaagaattttgacaagcagggtagcgagtcaaaaatgaatctatgaaattcagtaaaaagaaatggacaacattgcagttagggttaaatagtaatagctaatggccgagagattactgtgtgttagacacagtatttagtacttgaaacaatagaataatattaataaggcagacactattatcatcttctttccagatataaggatggtatgaggcacaaatatataaataatgagaagacttgtctcaacaacatatctttaaaacatcaaggagttatgttcaataacaaacaaaatatccagataatagaaaccaataatacctagtcttgaactcctgggctcaagtgatccttctgcctcagcctccagagtggctgggacaacaggtgcgtggcactgcacctagctaatttaaaaaaaatgtttttaagagatgggttcttgctatgttgtccaggccagtcttgaactcttggcctcaagcgatcctcccgcctcagcctctcaaagtgctggcaggcatgcgccaccacacctgccccttttcttatattagaaaaaatagtgagaatttatgaaatgaagaaaaaagattactgggtgttcattcaatagaacactaggcagcctgaccagtgccctccctctttcacgctatatactacacgtgttctccaacccatctgctggctaaattgcacagatatctggatcccacatcccactgcttagcattgtttatcaagcactgagtttatgaaggtggagagactgggccctatagtgaagagacttagattctgatctactgacaacaactaacctatgcccacttattaagcggcatgaagttttcaacaaaaatggtggtgggtgttaactgccacattataacataaggaagtgaattctaactgaatcctaagaataaataaaatgataagtgagcattcaaaggatcaccactagagatgtgcttcatttttctgctctaatatattgtctttgagcaataagagcagctgaaaaagatgcatagaactttagacccaaaagttgactttaagatcaattttttcaacttttgtcattctagcaattagaaaagtaagtcccttggcaagagaccttgccacaactgacctactctactcctttgtcaaatgctaaaacccagtttgcatctttctcctgcctcattcatattgctggatctttccttccatctgagaaatatttattttgaatggaatactgttgtataattacccaaactgtacttttcactttcacagaacaaggaaaaagaaatctttatttcacattctatataggtttatctcatggcagtccttttggcaaaatgctttcttttctgaaataagtcagtaacatatccacagggctaaattaattgctattctattttccatctcctctcatgacaagcctcttcaattgcttctgattcatcatgcctcctagtgtgaccatccagcttcctttctgggccctgttctcattctcccagagacagcataaaaacacactccatttccatacttgcattggtttccgagatgctacattatccctgatctcctgcctccctttctaccatttgtcttctttgagggctcttcttccagctttcaaaatatgaacatacatctaggccggctctctgttcttacttattcttacagtttcatcatatatacatttattcatttaagcagtatctactgaaggcctataagtagtggtgagtaagatggacatagtccatgctgttatggaacttacatccagttaaggaagaccagataagaaaataaataaaaaattccaaattgggataactgctaaggaaaaaaaagaaagtgtaataataaagactaatgggggtgaaggaaggtcttttgaaaagttaacatttacctgggatctcaagaaaaggcctattatgcaaaaggttgtgtatattcaggggcagagagatcaaatgttcgaaggtctttgggtgagtgggagaaaggttggttgtgttcaagaaactcagaacagagagtaccataggatgatgctgaagagacagacagacagcagatcatgcaaagccctataggccctaggaaagggtttgggttttatcctaaacataaggagaagttactgagggtgtaaagcaggaggttatcccattctgacttatagatcactttggctatcatgacttacagaactgatgaataaggtgatcatatatttagggttgcccgagatagtcccagttcatgcctattgtcctggcataactgaacttctgcattgatttcagggaagagtcacaatatgcaataaacaaatacatacataaataaaacaaaaaacaaaaaaaacaaaaaaaaaaaaagaaagaaaattgactaagacacaaacaagctgtgggaggcaacattcatcaggtttccttgttcctgatctccttgacctaactgggatccttccttgggtgctccctttgattcttgaactagttttacttctcaagcttgaaatatgttcttgtccttaatatctggctatctcctgtaattaaataatattcagcagctggtatacacaaatatatcgagtgaggtcctatttgcataaactcattcctcataacattccatgaagtaggtattatccccatttacagatgagcaaactgaagcacagagaggtaaagaaacgtgactaaagacaaacacagccaaagaatcaggacttgacaccaggtaatttggttctggaatcagtgttctttacttctaacattgcttctcaatgtgagaaaccgtaggcatatttaggaactgcaaatagctcagagcggccagagtgagtactgggacaaactggaggtaagtttagaaaagtagcagaagggtttcaaatgacatgcaaaacaactaagttttcatctgacaggtgatggggtacaccacaggatcttaaatacatgatcatatttgtgctttggataaacagctctgtggaataggtggaatagaaggtgggtaggaggagaatggttcctgactcagctttttctaaagactggacctgcgcctccttcctggatggggcctttggatatccattgtgaagaacctgcatgcaattataatacatgacttcccacaacctaggcctgggccttccaatgatgggatctccctttttaactacaacttttcctttgagtccctttcatcagctctcatctccaagtctttttataagcatacctctatttccacactgatcccgatagtctccttatttaaatccttatcaccacaaatgtagatttctgtagcttcacagctcagttaccttcttcctaacgccaccacctgcaatttcatgagctgcttttattttaatccttttaaaacattactcccttcatcatattattctcatgatcaaataccttactattgcttatacagatagtcttaactgttaacctaacattcaatgatctttataaatgatgcccaaatcacattttccaatcttctactatctcatctacgctgctgcagtcaaattttctacccatctataaactgtgtgtacacagtgtgtctttctataatctttggtcacactgttactctggtctagcaaaacgcattcttttaaaaatcccatcctttcatgatctggtttagcacttgccgactctaaacagccttcctaaaccactccagtgctgggaattcctacagcactcaaagccttacaccatattcctatatttgggcacaaactgcctcagtaacatgacatcccttccgttattgctctgaattttttattcatttcatatattaggatttagctgtttacaggtcacttttctaatgacatcaagaactactcaaagacacattgtgtgtgtatatatatatacacacacacacacacacacacacaatatatatacacacacatatatatatgtgtgtgtatacatatatctaaagacctataaaaccatgttttgtgggttttttttttttttggtatttctacttttcccatagtatttccatacctcaccagtgctaggtatggtactatcctatgtatattgtatacctcatgtttcttgataatttagaaaattcaatttatgctgctgttatatcttccagtaatataaaattttcagaattttaagagtttttcaggtagaaaaatttagcaaaaccaaaagagaaatggaggaaaaaaagtctaagaaaaacataaatgccagtggagtatgctaatgggaaaaaaatcaacataagcttcacaatttacaatgtctggagaaataaactgatgtgcttatacttaaacatgttatattacggaagactacaagtggttgttaaagagaacctattttgcatttatatttgaatttcgatagaactgctttgaattgctactttattgataagggaaaacaagttcttttatgacaagttataaaagcttatagtttatcagttccctctccaccctgcaattacctacaggaagagattggccatgggttctattttatgagttttataggggcccattcaccccagtttacatactatgaattcttggaaaatgcaatagattgtagaaaataaagtgcttcctttgaataaaggacatttcacttaaactcatacatgtatctacatacaagctgtcccaaatattatgttaaaatatgaaacagccatattttacatgaatatatgtataaagtatacaaaagtataatactgcaataggtagcaatcttgtcaatctacagaattggctaaacaatgataacaatctaacaacaataacaacccaacagctattgagtaagtacagatattatataatccaagagattcaggataaaatttaatttatatgattcagatcagtacatttatgaataagtttagtgttaatggcaaacaatattacaaacatctcagaaatatttcagaataacaaaataagactaacgcatattaaagtttactactgatgaaataccatgtgacaaaaattcattcagcccttagaaaactttgaagaaaggtaactgcagaaggaataaattaatagcttttaaaattggtcttataaatatgaagaataatgaatcaacatttaaatttccaatcaggttagaatgctttaaattctaataattaaaggaatacttaagacacatggcaagcgtttcatagttggtataatcctgatgagacagtctgaattttatttcaacctgttgtgatagatgtgtaggcctctgtgaaaatgcaagctgtaattttatatactgcccaaaatccatttgctaaaagaagctttgttctctctaccggggttacagggtcactgaataaaaactaaaaatattaatattagtgttacaagtttggaatgtaggagctttacaaaaatttaagttattcattcgaataggccatattgatgtcatttgaattttatcatattagttttcactggaagagattcaaaaacagtactcaagacactagaaattatatattcagtatggcttatcatgtttcaatgtattttacatgtatattaattctgccagaaaatatgaaaagctatgggatttgccaagcatatgactgtacactgaaaggtagatatgttttaactatgttccagggggaatacttccttatgctagttgccatttccctttgatttgcaaataagtccttcatttaaagtaaatacaggactcaaacttgtgctgacttaacaattaactaacttttacacctgccttttagggttcagacaataacctctgattaatctgggctgatattatccttaacttactataggcgataagcaagtgcagagggactaattcttaaagtggcatgatgtaagtcttttcatataatctaacatcatgattatctcatgtcttatttactttttctattatcaatagtacagtgtctgaatgaatatcattcaggacaaaaattagtgaaaagaaagccacacatttaaccatcaaatctgacctaggacattaggtataaagaaaataaaacaatatctataatatacgagcaggccacataggttccttacacaagagaatgactagcagtctgatgtccaatgtctcttctgcaatactaaacgccagaatgcaaagataatcaacttccacaatgttttgaggagaaaaggttaagttcaagtaattaaaaatcttggcaagctgtctaatagtaaaggcaattgacaagtatttaaaaatatgcagactcagataattcacttcccattttctaattcttgaagaacaactagaaaatgtactctgaggtataaacaaaatgaagagctcagcatgccaaaaaaattaagtgattatagacagttaaaaatagaggtttgattctttttgacgaaaggggtgtcacatcatgtggagatttttttcactttctattaaaggtatctcaaaaaaacaaatatggtactatttgtaagaaagaaaaaaaaaacccaaacaaaaaaatcaaagttcatgtagtaaatgaaaaacaaaaaggaaacaagtgaattaaaaagagagtgagaggtgacatggaacaaagggacagaggtggttttgttctcaggctgatctttatttactgaagggacactggattgtattatagtactatagaatcaaactcaagtttgattgaccataaccatatatttactgaaaacttcacttagaattccaacttggaatgttaagaaacatatcggctgggcgcggtggctcatgcctgtaatcccagcactttgggaggctgaggtgggcagatcacgaggtcaggagtttgaggccagcctgacctacacggtgaaaccccatctctactaaaaatacaaaaattagctgggcgtggttgtggacgcctgtaatcccagctacttaggaggctgaggcaggagaactgcttgaacccgggagacggacattgcagtgaactgagattgcgccacggcactccagcctgggcaacagagcgagactctgtctcaaaaaaacaaacaaacaaacaaacaaacatatctttcccttgaaaagaggtctgataaattctcatttgctcacttccctcacccatttaatggctgcaactagcatataccactctcctagaactgccattcatggcagtacttggagcaaggggaacgtgggcatgaaaatgggtaaagaagtaagctgggaattgagggttaggtctggggtcgagaagtcactcagggtcccagcctcagctattctaaaatcctggcccactccctttctgtttttttctcaggctctaacagatacttaaatcatggtatctcttctttttttgggtcagtagaatacaaaatttggggctacaaatattccactttgataatttttagactcctttttttcctccctaaacattttcttctcctaagccctttaaagaaaataagagaagataggttcaaggatggaaattagataaaattacatttctgtgaaaatcagactttacttgtcctggtctgggaccagagggcactgggcaataataatgaacagacttatgattctatttagaggttatggagaaagggcaaagattaagtgttggaaagccaggggctgttggggagagaggtagtaacatccttactttgtagtagagacacagaaggagaagagtagccaatccttcctcagaaaaatacatcaaaaaggactgaatatattattcaaatacattaaaataataaatttttcttaattgccattctttaattttttaatactaaagaataaaatttatatcatgttatggctactcttttagcatacttactaaaggataactgaaacatacatactacagtcaagttctttttaatgattatgctaattcctcatgtactggtcttttctaaagtcccacatattaagttatcaaacatgttaaatcaatcatagggatttattacaaataaaaaatagagtcaatttgctactgaggcatatattaatcatcaacacaattcaaatactttaatattacctttatttatttatttttgagatggagtcttgctctgatgccaggctgaagtgcagtggtgcaatctcggctcacagcaaccttcacctcctgggttcaagcgattcccctgcctcagcctcccgagtagctgggactacaggcatgcaccaccatgcccagataactttttgtattttagtagagatggggtttcaccatgttggccaggatggtctcaatctcctgaccttgtgatctgcccgccttggcctcccaaagtgctgggattacaggcgtgagccactgtgtccggccatctttattttcttaattggtacagtttgactatccctaatccaaaaacctgaaatatgaaatcctccaaaatctgaaactttatgaacattgacatgactttcaaagaaaatgttcattgggacattttggatttctaatttttggctcagggatgcaggaagtgtaacacaaatgttccaaaatttgaaaaagaccaaaatccaaaacacttctggtcctaagcattttggataagggatactcaacctatattaccaaatctttctcacaataggaaatggagaatcacaggaagtacttggaagacttatgaatgcaaaggataagaaataagagtaggattagggaatgtacagtgtactctatatcatcttatgagtctttcaattgcaaactagcaactaatatatgtttcacacaaatatcatattcagagactaaaagggaaatctaataattatcttccttctattaatacaactttttaaatatagtgaatagatgctataattgttaaatgccttttgttgagaagaaggataaaagataagacttcagttctataataataaagcaaagtaacctataagagaaatgaagcataatggccttttttcactattataaaacattcactttaaataatgatgctagtgcacaaaataacattcatttttagaagggtaaaaatcaatttgcacaaatacttacattacattatcaaaactataaattatttctaagttaacaacattaatatgaacaaatcttgcagggatataacttttggcaaaaaggttttaagagttttctacaatggcactgtaactataaccagtataattttgtactttcttaacacttttaacaacgtagcaacagactgtcttaccgttggtgctgtatctacctgatggttacaaggctttctttctatgctgataatccctgtggaaagaaaacattgtgagtatttggttattaagcctgtccattttatgttgaaaatattcatgccattttattggaaaaacatttattatgactcacacagcttccaagaaaaaagtctcacttggaaggcaagatccttttaagatgtatcatgaattctttggtcagaaacagttggtctaaactgactcaaggttagctaagccttttttcccattcaagtgatgtctagcaatagcgcaagatgtgtccacatcctgctctcaactcaaaaattacaccattatctgggctctgctgcttttcttccatgaaagttttatttctgattcaaggatatgaagtttttaaaaagaagtatcacaagggctatgaagtgaatcactactgtcttattttctcaaaagaataaataaatccatctgaatttctctttgatcatctgacttcctactatgacatactctatttattcaatcaccatgagtatctgaagaaaaatgttcccctgattccctcctttaaaatgataacacagatggctaatcttgagaaatattcttttatcatgtgtggatttatctttttgttcccaatgttctctactgcatttctttgtaataaacaccctttcaggacgtgacacaggggatctcatctgtaaagatactggttcaaagtctaactcaagttaaaaatgaacacaagtgtgggtcttgtttaattcctaatttctggccaccagcaaactaacatataatttaggatattaacatagtttgttcaaacaatgctaaaggctgtcatatgcaggacaagaggcaagaactacaatgtctgttaatagcaattagtaaaattcctagtttaaatgttagtttctcttctacaagcatatgactcatttttcttaaagtacggtaaaggattaagtgagatcaacacaaacaatcactttttatcgctttgcaagagtattttcaaaatgaatcatgaaacatgcagtttttgtttcattaattttttgtaacatttattgttagccagtgaagtataaagcactatactaccttcattcaattgactaatatttttgagtggttattcttggtactcagtgataaaagatgaatatattacagtttctgactataagagtctagtaaaacatggatatccttttctgaagaattaccacagagcaaatgaacagagtttcatcttaagtgtaataaaatctttaaggtaattttgatggaaagacactcttattcatagagtaacaccagttttgggttaattttttttcaaagggtacaacatgcaggcaaataagtaatgtagattcctattgtaagattttaacaatatagaaatatagagagaataaattgagaaatcccaactttgtcagcccctacagtctcacaatcctagctgcaaacactgagaatagtgtggcatggcaactggctttcaaatgagagtggtcatgccagagttcagcaattaacaacatcttacacacgtcttctcactattgtaatctgactgttataaaattgacctaggctgattactgatttttaaattcttatctaaacagaaagtaattttaattggagaaaaggaactttaaaataataaaaaccaaagcaaaccaggcaaaaatctatatatacagtttatacaataccaagaaaaaaacaaaaaaaactctacagattttagtgtttccattttaggataagaatgtgttgaaaattagaatttcaaaaactggattatccaaagttataatcttagttttaaatttagattacatatataaataatatttggaaatacaatcatgcatgtttgttcaagcttgcagtaaaaaatatatagaaaggaataaactttagaaaaaaatgtatcaaaataacttcctattttaggtaaattttacttaaaaatctgtatttgtatctcatttcacttttattaatgtataacaataattgaaagctcataataagtagcatgctataatggttagtattatatgtctacttagctaggccatggtacccagatacttgatcaaacattattctagatatttctttgaaggttttagatggaattaacatttaaatcaacaggctttgagtaaagcacactgccctccatgatgttaagtgggcctcatccaatcagatgaaggccttaagaaaatgacaactcacctgagagcgaggggattctgccaacaggctgccttcagactggaactgcaactctttcctacgtctccctcctgttggcctagcctgcagattttggtcttgccagcccccacaatgtttgagacaattccttaaagtaaatctttctctctctatggtcttcctactggttctgtttctctggagaaccctgactagtaatatacttactttctgggacatatgaaataaataaaaatgctattgcttatactctaaattataaatgttatgttcattcaacataattgtgtaggaatatagttaaaatgttgatgttagtatgaaatattttaaaatctgcatatatccgaatgaactcaggaatatatagatagaataaatcgacctatcaacaaataaaaatgaaaaaaattataaaagcagtctgtcagcagaataaagaatcaatctatcaataaatattactgctaggttgtccagtctaacaatctctgcctttcaatgatttgactatttacatttaatgcaattactcatatggctttgctgaagtttagcattttgctatcttattgcatttctttttgttcttttcttcctctttttctatattcttttgcaatagtcaaatagttttactcttccattttatgtcctctgatggctttttagttacatctcttcatattttttaatggctaatgtagagattacaacgtaccactgtactataccttgaattaggatttcttctacttcaagaataatataagcaacttaaaacagtgttaaccccatttattcaaccaccctttatgcttttgctgccttatatttaacttctatatgttataaacaccacaatatattgtcagtattgttgttttaaactgatatatttatctttatcccttcttgcagatccaggctttcacatgagatcattaatcccctgttattttgtagtgtaagtctgctggtgactatgttttttcctgaaaaatctttagtagggattcatttacaaagaatgttttgctgggtattgaaatctaggttaatagccattttcttttagaaaatgatttcattccattatttcttatgagaaggaagtcatcattcttactatgatttccctgaacgtaacacttttcccctctggctgcttttgtaattttctttttagtttaatcaggaggtacctaggtatggtttcacacacacacacacacacacacacacacacacacacacacacacacacgtgtgtatatttatactctaaaggaatataaatttttcattttcttcagtttaattaggaggtatctatggtttcatttatatatatgtatacgtgtatgtgtgtatctttggattttgctaagcttttaaattttattttttttgattttattttttatttcaataggtctttgaggaacaagtggtgtttggttacatgggtaagttctttagtggtgatttatgagattttgtgtatctgtcacccaagcagtgtacactgtacccaatgtgtactcttctatccctcacccctgtcccaccctttccaagtccccaaagtccttagaataagagtctccaattctatccaggttgctgtgaatgccattattccattcctttttatgactaagtagtattccatggtgtgtgtgtgtaggtgtgagtgtgtgtatatatatatatgtataaagaaaatgtggtgtatatacacatatatatacttggtgattgatgggcatttgggatggttccgtatttttgcaattgcaaattgtgctgctatatataaacatgtgtgtgcaagtatcttttttgtacagtgacttttttttccctctgggtagatggtagcgggattgctggagcaaaagcgctacttttcttaggttggtgcaaaagtaattgcagattttgctaattgaaactaatggcaaaaactgcagtaacttttgcaccaacctaatagttctttaaggaatctccacactgttttccatagtggttgtactagttcatgttcccaccggcaatgcagggatgttcccttttcaccacatttacaccaacatctattattttttgattatggccattattgcaggagtaaggtggcatcacattgcagttttgatttgcagttccctgatcattagtgatgctgagcattttttcatatgcttgttggccatttgtatatcttcttttgacaactgtcaattgtctatgcatgtccttagcccactttgtgatgggattttttttttcttgctgatttgtttgagttccttgtagattctgtatagtagtcctttgtcagatgcatactttgagaagattttctcccactctgtgggttctctgtttactctgctgattcttttgctgtgcagaagccttttagtttaagttccatctatttatctttgtttttgttgcaattgcttttgggttcttgatcataaagtctttgcctaagccaatgtctagtagtgtttttccaatattatcttccagaatttttatgattctgggtcttagatttaagtctttcatccatcttttttttaaattttattttattttattattattattattattatttttattgatcattcttgggtgtttctcgcagagggggatttggcagggtcacaggacaatagtggagggaaggtcagtagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctccaatgtctacctctttctacacagacacggcaaccatccgatttctcaatcttttccccacctttcccccctttctattctacaaaaccgccattgtcatcatggcctgttctcaatgagctgttgggtacacctcccagacggggtggtggccgggcagaggggctcctcacttcccagtaggggcggccgggcagaggcgcccctcacctcccggacggggcggctggccgggcggggggctgacccccccacctccctcccggacggggcggctggccgggcagaggcgcccctcacttcccggacggggcagctggccgggcgggggttgacccccccacctccctccgggacggggtggtggccgggcagaggggctcctcacttcccagtaggcgcggccgggcagaggcgcccctcaccccccggacggggcggctggccggacggggggctgaccccccccacctccctcccggatggggcggctggccgggcggggggctgacccccccacctccctcccggacggggcggctggccgggcagaggggctcctcacttcccagtaggggcggccgggcagaggcgcccctcacctcccggacagggcggctggccgggcggggggctgacccccccacctccctcccggacgaggtggctgccgggcggagatgctcctcacttcccagacagggtggctgctgggcggaggggctcctcacttctcagacagggcggttgccaggcagagggtctcctcacttctcagacggggcgtccgggcagagacgctcctcacatcctggacggggcggcagggcagaggtgctccccacatctcagacgatgggcggccgggcagagacgctcctcacttcccagatgtgatggcggccgggaagaggcgctcctcacttcctagatgggatggcagccgggcagagacgctcctcactttccagactgggcagccaggcagaggggctcctcacatcccagacgatgggcggccaggcggagacgctcctcacttcccagacggggtggcggccgggcagaggctgcaatctcagcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaatccccgtctccaccaaaaaaatacgaaaaccagtcaggcgtggcggcgcacgcctgcaatcgcaggcactcggcaagctgaggcaggagaatcaggcagggaggttgcagtaggccgagatggcagcagtaccgtccagcttcggcttggcatcagagggagaccgtggaaagagagggagagggagaccgtggggagaggaagaggaagagggagagggagagggagagggagagggagtgggagcgggagcgtctttcatccatcttgagttgatttttgtataaagtgagagatgaggatccagtttcattcttctacatgtggcttgccaattatcccagcaccatttgttgaacagggtgtcctttcctcactctatgttttgtttgctttgtcgaagatcagttggctgttaagtatgtgggtttatttctgggttctctattctgtttcattggtctaagatcagtactatgctctttcgatgactatagctttataatatagtttgaagttgggtaatgtgatgcctccatatttgttctttttgcttagtcttgctttcgctacatgggctctttctttggttccatattaattttaggattgttttctagttctgcgaaaaatgatggtggtattttgatggaaattgcattgaattttttattgcttttggcagtacggtcattttcacaatattggttttacccatccatgagcatgggatgtgtttccatctttttttggtgtcatctgtgatttctttcagcactgttttttacttttccttgtagagatctttcacctccttggttaggtacattcctaagtattttattttatgttttgcagctactgtaaagggggttcagttcttggtttgattctcagcttggtcactgttgctatttagcagtgctactgatttgtgtacattgattttgcatccagaaactctactgaattaatttatcagatctaggagctttttggatgagtctttagcgttttctaggtatacaatcatatcattggcaaacagtgacagtttgacttctttactgatttgaatgtcctttatttctttcccttgtgtgattgctatggctaggacttccagtattatgttgaacagaagtggtgaaagtgggcatccttgtcttgttccagttctcagggggagttctttcaacttttccctgttcagtataatgttggctgtgggtttgtcacagatggctcttattaccttaaggtatgtcccttctacatcaattttgctgagggttttaatcataaaggacgctggattttgtcaaatgctttttctcttgagatgaccacatgacttttatttttaattctgtttaagttgtgtatcacacttattgacttgcatatgttaaaccatccctgcttgatcatggtacattatctttttgatatgctactggatttggttagctagtattttgttgaggatttttgcatttatgttaatcagggatattggtctgcagttttcttttttttttgttacgtcctttcctggctttggtattacggtgatacgggattcatagaatgatttaggaaagattcccttgttctctatcttttggaatagtgtcaggaggattggtaacaattcttctttgaatgtctgatagaattcagctgtgaatccatctagtcctggacttatttttgatggcaaattttttattaccatttcaatctttgtgcttgttattggtctgttcagagtttctatttttatgctgttttatccagaaggatagtatatttccagcaatttatctatctcctctaggttttctgatttgtatgcataaaggctttcacagtagtcttgaacaatcttttgtatttctgtggtttggttgtaatatcccccatttcatttctaattgagcttatttggatcttctctcttcttttcttggttaatctcactaatggtctatcgattttgttaatcttttcaaagaaccagcttttcatttcattcatcttttgtatttttttgttgtttcatttaggtctgctctgatctttgttattttttctcttctgctgggtttgggtttggtttgttcttgtttctctagttccttgaggtgtgaccttagtttgtctgcctgtgctctttcagatgattgtaggcatttacggctatgaactttcctcttagcactgcttttgctgtatcccagcagttttgacaagttgcatcactattatcatccagttcaaagaatttttaaatttccatcttgatttcattgttgacccaatgatcatttgggatcagtttatttaacttccatgtatttacatggttttgagggttccttttggagttccttcatttatgaagcttagttcctctggatacaaaattcttggctgatgattgttttgtttaaggcggctaaagataggaccccaatcccttctagcttctaggatttctgctaagaaatctgctgttaatctgacagattttcctttataggttacctgatgcttttgcctcacagctcttaagattctttccttcatcttgactttagataacctgatgatgtgactaggtgatgatctttttgtgatgaatttcccaggtgttctttgagcttcttatatttggatgtctgtatctctagcaagaccagggacgtttccctagattattccctcaagtatgttttccaaacttttggatttctcttcttccaggaacaccaattattcttagatttggtcatttaacataataccaaacttctgagaggctttgttcattaaaaaaattttttctttgtctttgtcggcttgggtcaattagaaagccttgtctttcagctcttatgttctttcttttacttgtttgagtctattggtaagactttccagtgtattttgcatttccctaaatgtgtccttcatttccagaagttgtgattgttttttttcatgctgcttctctggagatttttccatccatatcctgtatcatttaaaaaatttctttaagttggtattcacctttctctggtgcctccttgagtagctaaataattgaccttcagaattctttttctggcaattcagagatttcttcttggtttggatccattgctggtgagctagtgtgatcttttgggggtgttaaagaaccttgttttgtcatattaccagaattgtttttctggctccttctcatttgggtagattatgtcagaggggaagatctgtggctcaaggactattgttcagattcttctgtcccacgggatgcccctgatgtggtgctctccccattcccctaaggatggggcttcctgagagctgtgatcgttgtttttcttctgggcccagccacccagcagagccaccaggctccgtgttggtactggggagtttctgcagagtctggtgatgtgatccgtcttcaggtctctcagccatggataccagcccctgcgctggtggaggtagcaggggagtgaagtggattctgtgatggtccttggttgtagttttgtttagtgtgctggttttgtgttggttggtttccagccagaaggtggtgctttcaagagaacataagctgtggtagaatagggagggtacaagcttgccctagggtcacctggataagtattcaggtttcttaggtggtgggcagggccacagagctcccaagagattatatcctttgtcttaaggtaccaggacaggtagagaaagaccatggtggtggtggggggcacccgcaggattaggtatgtctgaactcagactctctttgggcggggcttgctgcaactgctgtgtgggatgggaatgtggttctcaggctgatggagttactttcccaggaggattatggctgccactgctgtgtcatataggtcaccagggaagtgaaggaaaggcagtagttacaggcctcacccagttcccatgcatcccaaaatgccactctcgttcccactctacccctcagtagcaaagagtttatttccaggcagccagtgagcagggttgagaacttgccccaggctacaagcctcccttctgagaaagcaagcagggcttttaggttttgcaccttcccacctgctgtggattctgtgctcatatctgcactcctcatttgctccctcctttggattctgtccaggaaactttgccttcagttgaaattgttacagacttcagctagaagtttccttctccttgttgtctttcttcaattccactggcagccctccccaaggactcctgcaagacagtcaggaatgcaggaatggcttccctgaggaccaagagtgcccacagggctcttcccactgcttcctctacccctatatttcactcggctctctaaatttgtctcagctccaggtaaggtcaaatccttttctggtgatctggaccttcaggttccccagtgaggatgtgtgttcaggggtggacattccctctctcactctttgggcactaagtttttcagctgtctcacagagcatgtagcagcaagctgccccctctaacaggtctgtggattctcttggcttttctggtagtagttcttggagcaaaagttcacagtgtgattctctgtgcactgctctgtccgtccaagtgggagctgcaagttagtcctgcctcctatctgccattttgagacagcatcaacacagttatggaaacaagctttaaatgctgatgactgcttctccttgctaagctttttatgtctataggttgtctttaattagaggaaaactactagcccattatttcttcaaatatttcttcacccatattttctgttttccttctgcaattccagttgcatgtttaatccatttcacagggacacacagatatgactctttcttcttcccatgcctcctcttcatctttgtttcaatttgaataatctgtataatttttattgttttgccctccagttcagtggtcctttcttttaaggtgtcctatctgttgttatctgctgttatctgttgttaggtccatctaatgaattttcattttatctgttataatcttcaggtctagactataattcatttattttttaggatttccatttaagagaaatggaaatcctgacttccatgaaattctccatctttgcactccttttgctcatggttcctcataagttatttaacatatgtgtaacagatattttaaaattcttgcctgctaatgccaacattttgattatctgtaggattccttttattcattgttctttttctttgttatgggtcatctatttctgctaattcacatgcctcagaatttgattataggttagaactgccagacatgtaatcagtagactgaaatagcaaacgtcttccctcagaaaaggctcaccatttcctttttcagaaagctagggtgaggggtagatctcttttcaaatcaggagctgacttgggttgggactgggctgttgcttagttaatttcaatacacctattataactctccccaaaatgagatgagttattccttctagggggactttgggatttaaacttctagagattatgggaactctctctgccttactcccagtttcctgtcagtgcttaagcttcaaaagtcctcttggggagaactgataggcggagaggactgagtgacatttgggatctttcagattccaatctatcatgccagtccacatagtccttagaagttcagctaatctctccttgcctcagcagtagctctgattatagaaggcttgctcctctgtttgcctggtttctatctcaataaatgttcccatgtatttaagtgactgtttgtctttacttctttatgcagtagggttcatttctctttgcaatttattttgtttagaattctctgtgaccacatctctttgatggctttttagtttatgtgaggtcttctcaataatatggtaagagtgatgatcattacaatgtacatattaattagaagcaaaactctacttccaattatttatatggttgctttttaaaattttcttgttttcggtctatttcagtggatactccttttttttcttgcctgttgatcttgaattcttgttttcaattttaccaacacttaaaatctgctattagttcccttctggattctaacagtaataaatacatttattatttatccaaataaatttatgtctaaacctctctccaaccaagatactatacataccaatatctccttgctccacatcaagattaaacttttagaaggcttttatttctctattctttttatatagttaagtttaaagagataaaaatgcatgggaatttgtagaagtgctaagtgtgaatttatgaaacaaaatgatatagtgtaagaaaacacctaattttttcctctatgcctaacagaaaaatctaatgttttcctctgtcttgagatttctgtttcattgaattgtcatttggttacagtactctctaaatccttgtatatccaaatatgccttcctttggataagaaaccctttatcttggttgcctatatgttattccactatcagccagcttctagtgttttagatatgtcaggtgctcatgtgattttctttcctatgtaaagaacctgttcctcctctatagaagcttgtgatatttttcctttacctaggaaatcaggaatttcactagagtacggctgagtgcctttgttatcattaatcttttcccgggacttgataaaccctttgacctgcagagtcttatcattcttctgctcagggaaattttattctattatttaattttatagctcatctttaccttcacaacttttatcttcatgataatcttttcaactaatcttctatgtgaacatcctttctactctagagattttaacatttgaagtcatatagtttagtttctttcgaaagatctacaaagactaagacaagaaggctagcaaaccctggagtatatatcagaatgaagttttcctgggatctcagtgccaatatgtcaaggcaaagggttggggtgggaggactttgttctactcggtgttgagcaaggatctgtgcagggtaagcaggctttttccaaaggtgtgagtagaaaattaagttttcagagttcattgagggctttcagccagcagaagctataaatccccttggaaatgggcaatatctgtaagtttaatgtttgtagtacaataagggcctagcagatcctatgaatcataataaccctaaaaagggtctatacacctggaagaaatggtttctggaagaactggcattcagtcccagtcattgggagatggctgtaacttgcaactgatgagacttgagaagagagccttactcctgtgccccagcagaggggtatcagttgggcaggtttgattttgctacaactcagacttccatcagtatagctggggcaatagaccatgaagaggcaaagaaaataattttcttcaagagcctcagtagcctgaagaagaagaaataaactagaactggtagtgatactgatgacaatagaagaattagagagtcttttaaattaaaccaaaacaaacaaaaaacaactattaagatttcttgccaggtgcagtggctcatgtctgtaattccagcacttggggaggctgaggcagaattgtttaagcccgggagtctgagactagccctggcaacatagcgagaccctgtctctaccggaaaaaaaaagaaaaaaaaaaaagaaaaaaaaaattagctggatgtgggtgtgcatgtgtagtccagctacttgggaggatggcttgagttgagcctgggaggtcaaggcttcagtgagctatggttgcaccactgcactccagcccaggtgacagggtgagactttgtcaaatacacacaaaagtttaagttaattactaaacaacaagataaccctattttaaaggaaggaaacagtggctttcagaaagtaaattagaaggtaggtaacattcctaaggtcatataactaaaagcagcagtacctggactgacacccacacctctaagccacaaacccttcagacccatttatgtgtttgtttagcccctgtggttgggacctgatttttttcatcttcatatccacagtgcctaacccaaatgcttaaaatacagaaggtcttcaagaattgactcaaatattaactgaatgaatctattctcctatgccacattcaccagattcatatgctacaatgcagtgttaggtgtattagtcatcagaatgcctgagttaacgtactaggactgttttaaaaaacgttaatttaccctttggtaatgttcctaaacttagtgcaaaactgaaatgttttacagtcatgtgctgagtaatgatgttttagtcaatgacagatcgcatatacaatgagggtctcataagattataatactgcattttgctgtaccttttctatgtttagatacacaatttttaccattgtattacaactgcctatggcattaggtatggtcacatgctgtacaggtttgtagtgtaggaacagttggccataccatatagcttaggtgtagtaggctatactatctaggtttgtgtaagtacactctatgatatttgcataatgaaaaaaatcacctaactatgcatttcttaaaatgtatcgccactgttaagcaatgcgtgactatacttaaacatttccctaatttcccagatactaatacagtctagagaagataataaaagaaattttatgtttcttgggagacacttttagtatttattttgtagaaaatcagatcatgacattttattccattgtacctaatctgaacagctgaaagcatacattttttagttttcctaaaccctaccaacctttaactcaggactacgatcaaagaaagaagaacaaagacaaacagataggctgcaaaacaaaaacagacaggaacatgtgccaagttttgaagacagaacatatgtccagcaatcttatgtatcattaccaagtggttacaagctacttgctaagcacaaggcactgttctgggaacaggagaagctctaacctccctttcatgacatcttaagagttacttgtttcgggcaatatgatacctatgcatcctatgtcagttttggcaatccccggggatctttctatatagaacagagatagaattatggtttgattatctgtgcctatgaaaacatgagatttattacattccagtagaatacagttactgaaggcagagatcttttctgctagtttatatatacatatatatatatatatatatatatatatttttttttttttttttttttttgagatggagtcttgctctgttgcctaggctggagtgcagtggcgcaatctcggcttactgcaagctccacctccaggttcacgccattctcctgcctcagcctcccgagtagctgggactacaggtgcccgccatcacgcctggctaattttttgtatttttagtagagacggggtctcagtgtgttagccaggctggtctcgatctcctgacctcgtgatccacccgcctcagcctcccaaagtgctgggattacaggcgtgagccaccgcgctcggcccttttctgctagtttaatgtgaagaagttatctgtactgagactgcaagcctttcttaagaactggaaaagaaggtaaactatgttttgcagataatataattttatatctagtaagtccaaaagaatcaatgctaaaattaacacaatcagtaccagaactaataaactggaaagtcagcatcatataaaatttaatatacaaacgtcaatttctcttacatattcaaacaaattagaagatacaatgaaagagaatatttcacttataagggcaatataaataataatatgaataaatacaacaaaaaatgtgtaaaacagtatgaagaacaccttaaaatacttctgaaaaacacaaaagtccaggtggcccttgacttatgaaggtctgacttaacaatttttcaactttaccatactttgaaagtaacatgctttcagtggaaagcatactttgagtacccatacaactactcagtttttcactttcagtggaatattcaataaactacatgagatattcaacacttaattataaaataggctttgtcttagatgatgtggcccaactgtatgctaatgtaagtgttctgagcatgtttaaggcaggctaggctaaagtatgatgtttggtaggtttggatgcttttctgacatattatgggtttactgggctataactctattgtaagtcgaggagtatctagttggaacatcccatgttgtgtgacaagacaatgtagcatcatataaatgtgagctctccccaagacaatatataaatttaatatgattttaatttttaaaaagtttttttttccagcactagacaagttgattctgaaaatcatatagaagaacatgtaagaataccttaaaaaaatcccgaggggaaaaaaacgagcaaccactggaaataaacactactcaatattagtatatatcataaaaagcctctgtaactaaaataatgcaatattaacacgagtagccatgtagatgaacagaatagattaaaatgtttagaaaaagattcaagtacatacggtttatgaagaagaagagatgttttcatatacatggtgttgggacaatatgttggggacaagtggatggacattttgaaaaataaattgaatccatactttgcaacatttgtactgcaaagtcaaaagccaaatgacaaaatgggaaaaatatttgtagcctttattattgataaatgacaaggctccctattatgtcaaacgaaagcatacaaatatacaataaagacaactgggaatatcaatataaacttgattttgtaaaaatatattttcaagttatgttcactgaaaggatctagaaggaatgattccccaatagcaatgagtgtacttagtcccagattttagtttctaaattgcattacctactaatagtatcagagttctttggagaaatgactgattccagctctggggtagggatagtaccagatgaacttaggacattataagcacagaagtgctcaaaggctaactggttcatatcaaaggacataagagcaggaatgaatgggctctcctttgccaaattggggacaatttgagccacactcaaaaaatgttagaaaagtagtacaacaaattgaatgaaaaaaacccatagtactcatatagaaagaaagacaggaatggggggcggggcggggcgcagtggtgggggcaaagaaaacactctactgaagaataaggtgataacagcactagaaaacaccattttgtatcctcagcccactacaataattatttcaggctaggatcatcaatggacactgaaatcactaagtagggttactaagcccactaagtaaggaacacacacaaagaacaaaggaaggttgggaacaagatattcacatggccttaaagtatcattccacagattattcaacaattacaaagaaaagaaaattaatttttacaatgaagagatctggtgttcaccaccttaattaaggactaaacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagcactttgggaggccaaggtgggcagatcacgaggtcaggagttcgagaccagcctgaccaacatggtgaaaccccatctctactaaaaatacaaaaattagctgggcttggtgacgcatgcctgtaatcccagctactcgggaggctgaggcaggagaatcacctgaacccgggaggcaaaggttgcagtgagctgagatcgcatcattgcaatccagcctcggtgacagagcgagactccatctcaaaaaaaaaaaaaaaaaaaaaaaaaaaaaaaaaaaaaaaagttggtccagtttgactcaaaagtcaatgtcataacaaccaaagaaagattctagattaactgatattaatgacacgacaagcaatttaagtatgaatctggactggatgctgaataaaataagcaagcaaacaaaaaactgcttgagacttatttgacacaattacggaaatctgaatacgaactgtttattagattagaatcttggttatttttcttaggtatgataatggtactgtggttagacagtaaaatatccttactttagcaaatgtatgatgaagttttgggaaggaagaagaaaatgcaaatttaggggttttattttacatttttccaattttttatggttaaaaaaaatttcaaaataaagttggggaataataggccctgaatagacatttaattatcttacagtaggcaaactgaatcttcaacagttttgcctgaatagacgattatcttacagtaggccaccgaatctttaacagttttgaacactgtaaaatattccacataagcagagtaatctggctttgagttatttatttatttatttatttatttatttatttatgatacagggtcttgcttggttgcccaggatggagtgcagcggcataatcatggctcactgcagccttgatctcctgggctcaagtgatgcttccacctcagccacccgagtagtgggactacaggcatgtaccaccacactcagctactttttaaatttttttgtagtaacggggtctcactatgttgcccaggcttgtcttgaattcctggcctcaagcaatcttcctgccccaacctcccaaagtaccaggcgcatgaaccactgagcccagcctgagttcttattttaaaaatgtctcagcattattaaaagcaattagaaaacaaatagagcactccttctcaactctggatttatcagatcaccttcctaaacataagagaaagctaaaaaattaatgcatgaatgaataaatattatatatttatattctacatgttgactgctctattcaataaatttactatgtttattgaaaaataatgttttctgggaaaattactgtcccaaccagagatatcagttatttataattctccatgattagtatttgttcctttacaattagaaaaaaacatacttcaagggataatttattagtataatatgccctgactctggggccattctgcatgtattagaagactggctctgacaattgttagatatgtgatcttggactagttatttgcaactcacatctctgggaagaccttcttgggctatgccagtctttaataatctgtattatttattcccaaatattagtcaaaaataaaattcactgataaaatgaatacataaagttagcagatttaatagacttctaaactaatgcccaaataatttaattgtgctaaccaataatcaaataccaactatactaatttctacctaaaaccataaagagttgcctacaatttttagtatttgataaatttcctcagtaaactctaatatggattgaagtctgttcaaatcgtatcgtttgtgacatgctctatatattctatctgaggctagcaggatgtgttcctaataaagcctgccacatatttattacactggcaaagccaacaaacttcaattctgtgtgttcaatccttaaaatataatttaatatctgtctttaacattattttaacaataatgttatagattgaaagtagattaacaatagattaacatagatttaacaatatattatggactgaaaatcaaaagtataaatataacaaggataagaaaggtaaatttataatttcagtatttcctttttactgatttgttattacaatgcagagttaaaaaaatacaacaacaaaagaagcttcttgtattttcttgtttcctcctttttttccttactgtctttctgggtaagaaacatccaagttatccacctcatagtcacccctaatagttcttagtttcttttcactaaatagcctcttccagcttatctcattaactcccatgggctcaaataccacacatataccaatgactccttcatctatacttacactctaagcctatattccaaaatacactgtatagttcctagcacagggcttgactcatagtaggatatttaataaatgaggttcaaatgattgagcaagctattagatatcgtgtttcagaaatgccataatatcttgtaggcatttcaaacttaatatatctaaaatacaattcattatcttcctctcaatattcctgtatctcctattttcatttatggattgctatccactcattcacctaaattagaagcctctggcaccctcaaattctacttctctatcttcactcacattctagacctccacgttaatgatttaacatctccactctcttacttcaacccccttctcctacctcaattattaaatcaccttttaactggccttcctagctgtaatgccctaacaccttttatgattcttctcatcttacaattagttcacatactgtcttctctatgaggccttattgtcttctttaacacagaatttgttactatatcatctgcattctctagtacactttgttcattccttttacagcaaatatcaaactatgcaatcccatctacctacctatttaaaaataggtttccagtgaatactagcagtgctagggatggggctgagttctgcacttcattcctacaaggttctgtacaatctgggcctgctgctacctctctgaacttactgttttctactctcctccttgttccctccaatctagctatactgacctctttgctgttcaaaatgcataccaagtacattcctgtttcaggatcttggatggggatgctattctcccaaacaacttacagcttcctagcttccttccttcctagcttccttttttccaagctcccttccctttccttccttccttcctccctccctcccccaactccctccctccttccccttctccctccctccctccccttcaccctctccctccctccccttcccctcttcctccctccttccttccttccttcctccctccctccctctctttcttcttctttgtcgtcatctgaattttgcttaattctcagctactttgtgaagctttccttgaccactccatttaaacagcaacccaaccctactcctcaggtgcaactcccttccctgctttgtcgttataatgtttttatttaacagccctctgcatccatgggttctgcatccacgcattcaaccaaccatggattgaaactattcagaaaagaaatgcatctgtaatgaacacatagacttttttcttgtcattattccctatacaatacgggacaactatttatacagcatttacattgtattaggtattataagtaatctagagattatttaaagtatataggaggatgtacacaggcaatatccaaatactgtccattttatattggggacttgagcatccaaggaccttgctatctacaaagggtcgtaaaaccaactacccagatactgagggataaccagactacatttgcttaatgtcattctccactagaaggtaagctacacaaagatgtggagttttaccagttttgttcactgatacgttcagagcatgtataaaagtgcctgggacactgtaagtatgcactgggtacttactgaatgtataaatgctcttgcattcccagtacctgcatgtgtacaaattaaacatctttttaagtaaaataacccccccccccccaaaaaaaaagtacaaagttaaaacaagaagggatttaatggtggaaaacattttttggtccattacattggtatggtattgagaatgtgagatggtgtgaacccattttttccaggtctttccataaaagagacattttaagttctagggaaaacttttaaatttaaactttgaacataagcatgatgatttagaaaaagattttcatatccaaagcaaagagaagttatttttaaaaatatgcttattatgttattttttccctgcagtagttcagtgaacattaagcacattaatttgcctgttatatgtgcatttatatctgccttttacattagcttttaaagtgttttactttcaactcttcattaaatcttcacttcaaaatcagactaaaaagactgagataacattatgcctcataatgtcactactgaagaagggaaaaaaaaaggaaaagtggactcccacaaaaaacaagcttcactgattctaagttggccaaaacaaaacacctgttcatgccctatatttctcagacaaatttaacagcaatgagatgtaaaagacttgattccttttaaaaaaagtggcaagtatacacaataacacatatacatacaaacacccatatagacattaatatgaaatacaaacacacccacatagacattaatatgaaataaactggagtcctactaagcataaactcacttattctcagaatgccgtaagatccttgggaggcagatttgaagaaagcatactaagatcattatatgacttgtgacacatgagccttacaaaaggccagcaacgaaatccagattctgagttctaagctatcatttagagaactccaaaatagatgatactgttgtatactgcatgggcaagataaatttctaaacaaggccataaaactaagtgcactttataaggatgatacatgtaatcggacttactctcccctctgtgctgccacagtgttttatacgcatgccctgttgaatttaccaccatcatattataactatttctttgcctgctggactccccagatagactggaaagcctctgagggctttcatcttccatttctcgcagtgcttggcagagtctctgttacatagtaggctctccataaacaatgcttgatgaaatgcttcaattaacttttgaaaatattaaaaatgtttttattttttaaactgaataacagttttcattagagtacttctattaaaatgtgttatttctggttcttctcaaaaaaaggatggaaaccagttagaaatcattcttaacttttattccttatgaattacagttgaatgttttcttagagaaagttgaggaaaaaagtaaattgtctgaaataagaacaatgttccactttttacttattaaccatttataacacaaaaatctcttacattgtttaaaaaaaaatgaccagtcacgcatatagtcatttgtcactttccgtatttctcagtaactttgctctcacactggtaggcaagttgctgactaagaacaacacagtgattctttacattttcattcacttttcattcaaggaaaaggcttcttaaaaatgtgcatttaaaattctagaaaatacaaatcaacattatctctaagtctctatcattaccagaaggtctggttcctaaacctaatttccattgttagttaacatcttcaataagtgatggatattcatttccagaaaacattaccagtaaattctattatatcacagactgttcactatccagaccaaactgactaaaccacaaaatgcaaaagtatgcacttcacttctctaagggaaaccttagggctattctgagtatagttttagcagattatgacctaagggtaaatgagagcttaattagatagcctccttctgaatttccagagctttcagtagacacaaactaaaatgtttaaaaactaaaaatttcttgtcacagatttaattttttaaaaagttactctgagacataaggatttacaaaggaaataaaaaaaactgttatttttgtgatacaagtgctatttcatttttcccccagaggaggaaacatgaagagctgcttgcttggttccaggcggtgcccatcctaagcaaaattagtaaaaaaaaaaaaaaaaaaaaaaaaaaaaaaaaatatatatatatatatatatatatatatacatataaaataataataattttttaaaaattggatcacttaccacagaatcacagaatataatggctgaaatgaacactgatgtgaaatatgcgaaaacaagtatatatgattaatttggagaaaaagaccttttattttgtgaattaaaatatttttcattatcagaaatgtgtccaacattttgtatatataaatatatacactgtaatagtgaagaactaaagatggcttaaaattatgattgattgattccttccttcccccctccctttttttttttttttttttttgagacagggtcttgctctgtcacccaggctggaatgtagtggtacaatcatggttcactgcagcctcaacctcctgggttcaatcgattcccctctgcctcagccttctgagtaggtgggaccacaggcatgtgccaccactcctggataattaaaaaaacattttttttaaagagacagggtcccactgtgtggcccaggttggtcatgaactcctaggctcaagtgaatcacctgacgggattacattggtatggtatagagaatatgagatggtgtgaacccatttttcatacccaaagcaaagtgttgggattacaggtatgagtcatcttgctcagccagaatggaatactcattttcttcaaaggcatgtattaagtgtattatcagaaaaaaaaagttatagaaaaacctattttaaaatctaagtatttggaaatatattttataacaacatcattttatatgcccaattatcttaaaaattgaactgtccatttcgatttgagattacaaaattataaaatgcattttatggttgatagtaaactatattaatgtagtcatatcgtcaaactataaaaaaataaagttatgcctggtcaaaataatttagctactttataaccaaccctctcatctcacctgttgcagccatatggcattgttgtaattcttccttcaattctcacttttgagtaaactgattactgagtttcctttaccctagaggcaaagcagtgagttgcaaaacatttactactttcaccacggtataaattatgttccgataaagtagctgaaacctttcaagtcttctactttatataataaaaaccacttattgaaatgttttcaacagtatgcctgaaagttatatttagaaataatacatatgtaccacagaaatatagattttaacataagacatttactaggtttagttctaagaacatagtgctttccctttctaaaatttagtgggaagttagataaatttaaaataaaaacattcaatgattaaagtagttctgaatatagttataaagatacaatctattattcctattgcactgtaagacaaacaaattttggtatttaaaacctttcacttgtagtaaacattttcctgtcctctattttcaaatgacaagtctctgaaatgaaataataacttgctcaagtcacagcattaagcaacagaatatggatctaaatacaaatgcctctgacctccggctaagtgctaccagaatctcatgtatttatttaaataggaaaaataagacacttctagagtccctattcaagctaatcaaaattgcttattaataacatcttcaaaatcatgatgatgaaatgccaccacaaaatcttcaacattaggcaagttttattattaaaagtgttatttgcattcagttttttaaatggtaatctattctttatattgtaacatctgatttgctgggagtcagataatgaagtggattttataaacttgcactggcccatatggtacctgctggctagatgtggtttttaaaatgtaaattggacaggcatggtagctcacacctataatcccagcactttgggaagctgaggtgggcggatcacctgaggtcaggagttcaacaccagcctgcccaccatggtgaaatcccgcctctactgaaaataagaaaattagctgggcatggtggcaggtacttgtagtaccagctacttgggaggctgaggcaggagaatcacttgaacctgggggacagaggttgcagtgatccgagatcgcgccactgcactcctgcctgggcgacagagcaagacaccatcccccccacctcccaaaaaagtaaattaattaaaatgaaataaaattaaaaatttagttcctatgttacaccagcctctagctaccatgatggattgtgtacatctagagttcagaaaagaggtatgggttgaagataaatatctgaaaatcactggcatatgagttaaagtcatgggatcactaagggagtgggcatatatagggaataaaacagggtcaaattgcagtgaaaccatcttataagacatggaagaaaagaggaaaaattagcaaaggagaatgaagagtgcctaatgagataagaggcaaaacaagagaatgtggtatcccagaaaccatgtatttagaagtgatccaatgtgtcaaatgctgctgataggttaagcaagataagaacaaagaattgaccactggaattagcaatgaaaaggtcacttttgagcttgaaaagaagagattagagatttcaacaaattcatagaagacggaaaacgattagaaacatctgtctgaaaacattattggagggctgtagtagatatagaagctatctgactatgaaacctgtgaatttggaatcagcatatttgtatgggggaaaacctgactgaaaaccaggagaagtaacagaagattcatttgtacaatacgtaagctaaacaggctgtgaaatccctggaaagtgaaggatgcccagcattaacagcctgccacaaaacaaaaacaaaaacaaaacaaaacaaggaaacattgattgatttaggaaggtgtaatggcagaaatcagtgtctttaaattctttcttaacttaccccagacacataagtctgaggctttaatatattcacaacatttttaccatttttatgatgttatagcatttaccaatgggagaacactgatcacactgtagtgagtaactgtctacttctaacaaaaaactgttgactcttgaaggcagggtgtataatttttaatctgaacaactagcacaaaacatatcgtctggcctactataagcagttcagaagctgaatacaacaagtggtttctgaaggataaaggctgaattagaaatttggtgttaattcctaatctgaagttcattcctccacgtatcagtgcttctgtcaataaacaattgtaacaaaacatttttggtaaaaaaaaaaaaagcaccttttcttccattttgatgttatctactatagaaaagtgttttgtttttttttttcttttttgagacggagtctcgctcttccgcccaggctggagtgcagtggcatgatctcggctcactgcaagctccgcctcccgggttcacaccattctcctgcctcagcctcccaagtagctgggactacaggcacctgccaccgtgcccagctaattttttatatttttagtagagacggggtttcaccgtgttagccaggatggtctcgatctcctgaccttgtgatccgcctgcctcggcctcccaaagtgctgggattacaggtgtgagccaccgtgcctggcctagaaaagtgttttttcttttctttttttgttttttttgagacggagttttgctcttgtcatccaggctggagtgcaatggcgtggtctcagctcactgcaacttccgcctcccaggttcaagtgattcacctgtctaagcctcccgagtagctgggattacaggcgcccaccaccatgcctggctaatttttgtaattttagtagagacagggtttcatcatgttggccaggctggtcttgaactcctgacctcagctgattggcccacctcggcctcccaaggggatcataaggcatgagccaccccacctggccttttttcttttttctttttgagacagggtcttgctctgtctcgacctccaggctcaagtgatcctgccatttcagcctcttgagcagctgggactataggcacatgccactacacctggctaactattttgtattttctgtagacagagcttcgtcatgttgcccaagctggtctcaaactcctgagctcaagtgatcttacacctcagcctcccaaaagtgctgggattacaggcatgagacacagcaccttgttgaaaagcattttcttaagagaggaaaaactacaggttgcaaaatggaattatatgaagtatctcaagattttttgatacctctggggattatgttcttagagatggtcaaattctaagagaaacagaggctagcaaatggagttctgttgttgcttttgttctattttaatgtctgtggaataaaggattgtcccccaaccgaacccatgccctgtagattttggccagattacacagatgagagaatactttgattttaatcatcttaaaatctcaatgttatctcattacatgccaaagacggcttaagggtggtactcgtgtagaaagctaaagtttggaaagttaagtgttctagtggattactcaagtttaagatgcttgacaactttcttcttgaaattacttcatcttaatgccttttttggcatgcttctaaaaatactatatccattatttgtctctttgacatgttccttttcctataatcatcacttaacaaattttattaagttgtatcttaaaatatcttccactcttttggcaataaaacaaactgtataatttcaaactaaaaaaaaaaatcaaaaaagcctcccataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcc

SEQ ID NO: 2615 - DNA, 213795 bp, Homo sapiens; identical to SEQ ID NO: 2614

SEQ ID NO: 2616 - DNA, 193039 bp, Homo sapiens
catggcgaccgatgcgtcccgcgctctaggcgaagaccgcggccccgtccccgcgcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggtaagggacccggaaatgcgcgggtgcccctacagagtcttgagttttccccgccctcacctccgaaaatgctcttttcgccttagaattgtagctagcgcagggaaaaactgactgggcaaaggaaaactggggaggctgtcatggaagccgcccagaataagaaaatgaatgaatgaggcaaagaaacagatttgtcactccccacgcgatcgcgcccacaaaagaaaacatggttttaaggcgtggaaaatgaagttgtactacagacaaaattttaagaaaaaattatccactgttcctttagagctatctccctgtgtgtgaaaaacaaaacaaaagttaaaacgccatccttttctacacctaatgctccctcccacttttctgatttctgccacaggcgccatcttcagctctgagtcaccagggctggaaaaatactagatgcgctactcgtggactcgtgaatacactcgtgaatacaggccatttcctgtacctacagccacccgctgtaagctgttgcttcatttgtacagtaagagtttatggaggccagcttttccattcttactgacattgccacaccttacaaactatatgtcttgtgcttccctaaatcctgtgaggaagcaacgagaaagattactaatccaatgcgtaccgaactgagctgttcaactttccgttctaaacatactctcctagatttctatcttgctgtaagccaccacaatcctcccagtgttttagtaagaacagtagagtatcctaaatgcatcttatgccaaagcatatccattctctctttttaacttcctcagatgggccctttaccagttctctgactccagtttgactcttaaattctccacactgctatcagaatgacctgactaaaaatgtaaatcggataatggcactctcctgctgaaaatttttgaaaggcaatctgtaagagaaaatgattactttgcctaggatacaagattctccatctccctgactagtttcatctctcgttagcttcttgttccaattttatgcaatattgaatcatgtgtaccatgcagttttatgcaacattgaattatgtgtaccatgaaaaacaatccatagcctttcacgccccgtccttactcatattgtcctctcttcctgaaaattcctccttttacactcctgcatcacagccaaatgttgtccatcctttgaatcttaagcaggttgactgactccttcaaacactcctactccctattagacttcggatactcattctatatattagactttggatgctcattctatagtttcatagtttactttgtattttctctatccccagcatctaccacagtgtctatgaaatagttggcatttcatgaacatttgttgaatgaataatggataacatatattgagctccttctaggaggtatgcattgtaggtgttttatgtacttttcatctgtcctcacaactgcatttaagtacctgcttttccaaagggaagttataactctgactgctcattcttagtagggtgttagtttcagaatacaatccccagactagcggatgtgtaaccctgttatcatctcttgcttctccatttacagtagcatgcagaggtgcagtggggtgggggaggtcagggaatatttcatagcagaagtgacatttaagtaaagaccaaaataatgtgtagagttgtccaggttaggaagggtttccaggtagaagaaggtggcgtatagtgttcactacaagaaagtttggtataatacaagaactggaagaaaaaaaaaaaaagttcaagttggctaactaaaaggtagagaatgagactaggggcttttggaggagacaaaacaagagagttaaacaagctatgaagagacccagacagtattggtcagtggaataccactatagaattttatggagtgaaattttcaaattttaatatcataaagataactctggctgcagggtggagaacagacaggaaggaagcaaatctagatctgggaataccatttaagatgccgttgctgtaagccatgtaagagacaaaggtggcatggtcaaggctaagaaaaatcagaatggagagaaatggaccaatttgagaaatttttaggaggtaaaaatgtcaggacttagtgattgattggatggaagagtgaatgataagaaataataaaaaacgatgaccagctgttttgccttccccttggcaagtaaagaggtggcaagcatgaaaggggagtgaggaaataaatatgttgggtctaatgggagccaggtttctcactgacagagaaggacgttacaaattgagagaggaagaattccacagtgacctttgtggtgatgttgaattggaattgaatatgtcagtgtcaactcatagttttcaatatatacataaacatatgtaaaaataaatatagaggaaagtatgtctgtatgtgtgtgcgtatctatctattatgctcttcctagctctatctgctgaaagggtttcagagtaatggtatactagaagcaatgagcacatgtgcctagatcttggtttctgaacagtattattcactaaaagtaactgggtcccttggagaaatggttgattttagaacaggagcctggaaaattcttgttgcaccagaagttaaggaagttaatacagaatgaagaaacatatcaaaaggtcacagaagccagcttgaaggagccaccactggccacatctgggtcaatctgagcaccaatataatgttaatggattatagtccgctaaataaaataggaatatttgagcccatactaaaatgaataaatgatttttttgaaaaatcaggataaagaaaagctctgccttacataaaaatgccaactaaatgtaatgaatgtagacagtgttatatgtagaaacatcattatttggcagtcatgatagtaacagttgattcagactagaatcatcagtgtatgctaaaactagagggtgagagtattaagagacatataatatttatatagtctcaaagtatctctccagcaaatacttattaattacacagagaaaaattagaaaacttgacagtgtagaaatctggcactggtgagcgaagttaccatcagcagtcatgagacaaatcagcatcgtgtatgtcctggttagaggcacttagaatacacttctgtgacattcctgccaaaaatgtgtaatccgaatcaatcgtgaggaaaaaatcagacaacccaaatgtcccaaattgagggacattctacaaaataatagacctgtactcttcaaagatcaaggtcatgaaagacaaaggaacaactaaagaacgtttttagattgaaggagaattaagatacatgacaattaagtggaatacatgattctgaattgaatccttttgctataaggatattattgggacaactaacaatttgaatggggtctctggattagatggtagtattttaacaatattaatttcctgattttgatgactatagtgacatagatatttttggttttagaaaatacatattgaagtattaaaggtgatgaggcttcatatctgcaacctattcaaatggttcaggaaaaaagtatacataaatactgtaaataaatataaacataaataatatacataaagaaaatgataaagcaaatgttaacagggaatttgggcgaaagcagaagttctttatactattcttgcaatttttctgtaagtttataattattttaaaactataaaagaagtttgaaaggtgccgaggtttctggctcaggtaactgggtggagaatggctaatcagttaacgacaaaaaatcaggaagagcaagcatggaggaaaagatgtttagttgcaatgggatgtatggagtgggatgttcagcaggcagttgagtatatactaaacatattaatgagccccattcaaactgaataaagcagatatgttgctttagctctcattagtcgagagtgcaagaccaagggcactccgctatcctaggagaggcaaacaattaagagtggtagtatggtaataattctaaaaattggctgagtatccatgaaaaaaattgtgtgtatatatatatatatacacacacatatatgtataaacatatatacacacatatatgtataaatatatatccacatatatgtatatatatacacacatatatgtatatatacacacatatatgtataaatatatatacacatatatgtgtatgtgtgtgtgtgtgtgtatatatatatgtatgtatataaattgaaccgtttaggaataaaatagatttagggtattcgacacatttaatacataatgaatagtgaatttcttgaataatataatgcctaaatgtgactgatatgcaaaatatttaaatcccttacaggatgtgcatttaccaatcagaacagatgttggctttactgcttgtattagttttctgtattagtttgcttgtattagtttgctggggcagccataacaaagtaccacagaaatttatattctcacaattctgggggctagaagactgagataaagatgtctgcagggttggtttcttctaaggactctcttgttggcttgtagatggttgttgtctccctgtgtcttcacctgcacttccctctgtacctgcccgtatcttaatctcttcttataaggacagagtcatattggattagggctcaccctaatgacctccttttaacttaattacctctttagagactctgtcttcaaatacaggcacattctgaggtactttaaggttagaacttcaacatatgcatttggaactggggcataactgagtccatgacactattggagagggttctggagccataacagatggaatgaatgggccttgtttggattctaatttaaataaaccaactatagaaaaacatgttttaggcaatcagattttttgttatgggctaaatatttagaagatgttaagaaatgtttattaatttcattaggtaaaataatgttggtgtggttatgtagagtatgacttacgtgcacagaacagaatgataaggtgtccaggatttgctttaaaatattctagatttttttaaaaggtgagaggaaatgacacatgtatatctaaattttgatggttgttgaagctggctggtaggtacctagtatttcattatactttttcctttgtgtgtttggaaatttttataataagcaggaaaaataaaagtaagaatatatgtattatagataatttgaaatatgtagaatcatgaaaaaaaggaaaaaatactcaataccactacccaagagaatctaaattaacttttttgacaaatttcgtttcagtctgttttccatgcgtattttaattttggtcatgttgtgtgtaaaatgtttatttctgcttacttgaatgaacattatgttgcaatttcatttccatgctattacaatagtgcccccttaaccatggttttgctttctgaggtttcactcaacaagcttggtttgaaaatttttagagagaaaataagagattacatttacataataactattaatacagtatattgttataaaaactttatattgttattagttattgctgttaatctcttactgggcctaatttataaattaaactttatgagaggtgtgaaagttgattatagaaattgggtcattcttgttgtacccaactaaatcagagtgaagggcccaggggaaaaagcatttggggcatatagcatctgctccaagaattaaattttccacaagcccagctactgaaactgcctgttgtaatctgaaatcagttttatctgatagctaatgaaataacctgctgtgacactaagattagttttacccactgccatcactcgccaatcagagctcgccagctccccaaatgttacccattgtttctttgcaaaacaatgggtaacatttttcctttttataaaacctccaacctgatctttgtttttcagacatactgaagaccacccattctgtgtgtttgcctggaaatgcaattctcatttcccaaataaaatgtttgaaatgtggaaatttgactctatgttttatttgactttgagaaaggcatgcaagtatagtaaatacaggctttgctactacctgtagtttcagacatccactggggatcttggaacatatcccatgcagataagaaggagatgctgtatatatcaccacttaatcatcactggaaattctaactttgttagtaatgttcttatgtgcacgtggaaaaatttcaaacaatcgttcagatatttataatgtggtaaccgaaagtcagccgtgtttttaatcactgatcagtcttctatacattctttcatacttccattcatacatatactaaatatactaaattataaagataacttcttaccatagattttgtcctgtcatcttgtttttgtcctttatcaagtattattatttctaaaaggctttttatgtcagtaacatatatctaccccattcattttaatggctttatgctatatcacttctaatccaaagtgtttttaagcaattatagtgaaagtgtcaaaaggtgatatggtggcttttaaaaaataagatacttttcttataagtctctcatattattatttattcctcagcattttatagatttttggtgctattttgaatgcatccaattcttattacattttctaaccggtgattgcacattttcctgcttttcctctttctagggctcctttactagttcatgcctatcaccttgacctcttgatattggaatgtcccagaggtatgttcctggacttctctatctacacgtactcactcagtgatttcttacagttctatagtcccactgtcatgtagactactcccaaatatatcccttctgcccattattcttccttgaacttcagactcataaatctaactgtatattacatgtctccacttagatgtccgacatattctcaaacttaacttttctaacactgaattcctcatctgcctcctcaaatccccactttctccatctcaagcaatgacaactccattcttccagttactcaagccaaacaccaaatacattggagtaactgttaaatcaagcttagcctaaaactacctccttacatattttaaattcagcctaaatgtttctttgtacatcttaaactataacaagtagaagtgtaaccagatgtagcctacacttgggccaatcaccaagttttggccaatcaaatgtcgtcaactattcaaaccatgtttaaataaggcaaacacaaagctgtaaccaatccagctggttctgtacctcacttccattttctgtgcctcactcctttttctgtccataaatcttccagcacatggctgcgctggagtctccgagcctactctgtctgggaaggctgtctgatttgcaaatcattcactgctcaattaaattcctttaaatttaattcagttaaagtttttcttttatcataacctttgacctttctccttttcttataccccatatccaacctatcagattactataggttcgaacccaaatcctatgaaacagaggatatggttataattttgagggaagattttttttttctctacctgaactttagcccctacaaacaaacttccttgtttatctttgctgctgtaatcttttaagggttccacttttatgcaaacatcttagttctcacactgagcaaggccttgaatcctatgctttgggaggccattgcattctaagactacattcctggcatcagcaagtgcccctctagtaaaaatgccctcagcccctactttccactcttgttttagttctttcttctctttggcccccgaggaattcaatgatgcaatttagtcagcatttctagctggttttcaggttttttttttttttttcagagtatctttgtgacatattgggaaaagaggaattccttctctctcaactgttaatacatgttgaaaggaattttatgagtaatagtaatggctttgtaatagtgattgttactcaaatttagcagatgacttactgaagtaattaaaccttccttataccctttctgtgggtggcatgccacgaaaactcgatcaacctgtatacatgggttaggtagaacccactgagctttccattatgtataaagctgtctgtagatttactggctgtgtataaataccattttattaggaaaatgttttggtttaggtctcagaaggtcccatgaaaaacagtaacttctgcagagactaaggggaagagttaaaaaatagtaataatttaaaaatccatttcagcatatgattaattcagttgtctaaagcaatgagcactagatggcagcatatcaatgtgtatcgttacctgtgcctgaaagacctcattttaagggtgtgtaaggtcttattgctgttttaccatgcaccagtttgctatcctgaactatttactttactgtttaatctgttggtttgaacttataatagttgatgagatgtatttgacaccaggtttgaaaatagagtttctagattaataaatatacaggatggtgccggtaccaccagtctgtctagcaaaatatgcaagaattcagagccctttcctgtcattaaaggccaccctccagagagcttatctttcatctatgataagaggtcttctggttggacaaaaagcacattttggacactcattcctgtcttgagtttcaaaccttttgtggccgctaatgtttaacttttcatcttactattcaaatggcatctctttactagattggaaaccactttcgtatctcttaccaagtgtgaaaataggggcctcccaaactctgttgtgggtagttaccaggtcttcttctctaaaggactcaggtcagatatctctgtcacagatgagaaaggaatttccttcttatcacatttgattgtataattagtatttaaaatgtaaaaaagaaaaaatgacataactttaatgtataatttaactggatggctccatttttctcttgttaactcagatcatttataattttttttcttttaaaatgtttagaataaattattaaagtacatgttaataatacaggagggggctgggcacagtggctcatgcctgtaatcccagcactttgggaggctaaagcgggcggatcacttgaggccaggagttcgagaccagcctggccaacatggtgaaaccccgtctctacaaaagtacaaaaagttagctgggcgtggtggtgtgcgtctgtaatcccagctactcgggaggctgaggtgggaggatcgcttgaacccaggaggcagaggttgcagtgagccaagattgtgccactgtactctagcctgggtgacggagcaagaccctgtctcaaaataataataataataataataataataaaaaaaaatagataaataaagggcttacaaggaaaaattccaaatccctgcttcacctattccttgccacagtactgttcctgagaccaaattggcttaaatagcttctgtttttgtttcttctgatgattacccatctcttactactatttcttgattcatcagttttaaatattgtcttaatctattgtggagagagatgggcagtgatttaactcattagcattgccttctactgtccctatccatctcttcccaataaagtcatagaaagaggcacagcagtataatagataagagcacagactcaagtcctacttgcaccacttgctggctgtataatcttaggcaagttactcaagctctctgagcctcttttttttctcatgtgtaatatggggataataatagtcaattccttggaggattattgtgaggataaatgtgtcaataaatttaaagcactaaacaagtgttactattactattactacatttaatttctctttgcatgtttaaataacatacttgcccctttgtttttgagccctgtatgtattatctcttgatacctcccatcgtaagaagatattgacaactttattcttcccttcactcccgccctcttctgcatcttaatctcaccttttattccatctctaactgcttttctattctctgggagatttttttaaacttaatcttctaaccatatattgaaaaatttactttagcaataacatttataatttctgagagttttatttctaatgtttaattttatagaatttaaagattcagtattttcttgactattgtgttagagttcagtcaaagagcaaaaatgaccacacccataatttggatagggaagataactgtgaactaagtaaaggatgtattaactactaagagagaactgtaaaatataccgaggtagtagctgcaaaaagtacctgctactcctaggattgaggaaaaattgaataaggaaggaaactggaatctccagaggcagagattcaggcctgagtgggcatggttgccgcaggaatgcccctctgctgctgtgagaaacaccggagggacccttgcatgcctgacaagaggaaaagaacaccagaacaaaaattgcctcttgatcatggcttatgatcctttggatgtgctgtggaatttggtttgcttgtccttggttgaggatttttgcatctatgttcaacagggatttgggccttgtcatttcttttcttgtaatgtccttgtttggctttgatatcatgctaatgctagccttgtgaatgagtttgcaagtgttccctcagcttcaattttttggaagagtttgacaagagttgctgttacagtaattaccagtgaagtgaaagagctttgcgctttttgttgttgttgttaggaggctcttgattaccgattcaattcccatactcattattggtctgtcagattttctgtttcttcataattcagtctaggtaggttgtatgtttctaggaatttatctctgtcttccagtttatccaatttgttggcatttaattgttcatagtagtctcttagaatcctttgtatttctgtggtgttaagttttaatatctcttctttcatttacaattttatgtatctgagtcttctcactttttccctcagtttaagtcttgtcaattttgtttatcttttcaaaagataagcaactctgagttttgttaataatttctatttcttttctagtgtctattttacttgtttctgctctaatctttattgtttcctaatttctagtaattttgggcttagtttgttctttttctagtttcttgaggtgtaaagtcagattgcttatttgagatctttcttttttctaaattattatttattattattattattattattattattatactttaagttttagggtacatgtgcacaatgtgcaggttagttacatacgtatacatgtgccatgttggtgtgctgcacccattaactcgtcatttagcattaggtgtatctcctaatgctgtccctcccccctccccccagcccacaacagtccccagagtgtgatgttccccttcctgtgtccatgtgttctcattgttcaattcccatctatgagtgagaacatgcagtgtttggttttttgtccttgagatagtttactgagaatgatgatttccaatttcatccatgatgtccctacaaaggacatgaactcatcattttttatggctgcatagtattccatggtgtatatgtgccacattttcttaatccagtctatcattgttggacatttgggttggttccaagtctttgctattgtgaatagtgccgcaataagcatacatgtgaatgtatctttatagcagcatgatttatagtcctttgggtatatacccagtaatgggatggctgggtcaaatggtatttctagttctagatccctgaggaatcgccacactgacttccacaatgattgaactagtgtacagtcccaccaacagtgtaaaagtgttcctatttctccacatcctctccagcacctgttgtttcctgactttttaatgattgccattctaagtggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccatttcgtaggttgcctgttcactctgatggtagtttcttttgctgtgcagaagctctttagtttaattagatcccatttgtcaattttggcttttgtcgccattgcttttggtgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccattgattatatagggaatcctttcctcattgtttgtttttctcaggtttgtcaaagatcagatagttgtaaatatgcggcattatttcagaggactctgttctgttccattgatctatatctctgttttggtaccagtaccatgctgtttggttactgtagccttgtagtatagtttgaagtcaggtagcgtgatgcctccagctttgttcttttggcttaggattgacttggtgatgcaggctcttttttggttccatatgtactttaaagtagtttttttccaattctgtgaagaaagtcattggtagcttgatggggatggcattgaatctataaattacgttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtctgtcatagatagctcttattattttgagatacgtcccatcaatacctaatttattgagagtttttaacaatccgagtctctgataaaacagactttaaaccaacaaagatcaaaagagacaaagaaggccattacataatggtaaagggatcaattcaacaagaagagctaactctcctaaatatatatgcacccaatacagaagcacccagattcataaagcaagtcctgagtgacctgcaaagagacttagactcccacacaataatagtgggagactttaacaccccactgtcaacattagacagatcaacgagacagaaagttaacaaggattcccaggaattgaactcagctctgcaccaagcggacctaatagacatctacagaactctccaccccgaatcaacagaatatgcatttttttcagcaccacaccacacctattccaaacttgaccacatagttggaagtaaagctctcctcagcaaatgtaaaagaacagaaattataacaaactgtctctcagaccacagtgcaatcaaactagaactcaggattaagaaactcactccaaactgctcaactacatgtaaactgaacaacctgctcctgaatgactactgggtacataacgaaatgaaggcggaaataaagatgccttttgaaaccaacgagaacaaaaacacaacataccagaatctttgggacacattcaaagcagtgtgtagagggaaatttacagcacttaatgcccacaagagaaagcaggaaagatccaaaattgacaccctaacatcacaattaaaagaactagaaagcaagagcaaacacattcaaaagctagcagaaggcaagaaataactaaaatcagagcagaactgaaggaaatagcagcaaaaaaaaaaacccttcaaaaaattaatgaattcaggagctggtttttcgaaaggatcaacaaaattgatagaccgctagcaagactaataaagaaaaaaagagagaagaatcaaatagatgcaataaaaaatgataaaggggatatcaccaccgatcccacagaaatacaaactatcatcagagaatactacaaacacctctatgcaaataaactagaaaatctagaagaaatggataaagtcctccacacatacactctcccaagactaaaccaggaagaagttgaatctctgaatagaccaataacaggctctgaaattgtggcaataatcaatagcttaccaaccaaaaggagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacgaccaaaaaagagaattttagaccaatatccttgaaggacattgatgcaaaaatcctcaataaaatactggcaaacgcaatccagcagcacatcgaaaagcttatccaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattctaaattattattaaagcaggctttatctctataaacttctctcctaaaactaattttgcagcatctcataagttttggtatgctgtgttttcattttcatttgtctcaagtttttaaaatttcttttttgatgtcttctttgacctattggttgttcaagggtttgttgttaacctaaatgtctactgacagatgaatggataaagaaaatgtggtctatacatacgatggaatattactcagccttaaaaaagaaggaaatcctgccatttgtgacaacatggatagacctagagggcattatgctgtgaaataagccagacacagaaagacaaatatgatctcatttatgtatggaatttaaaatagtcaaactcataaaagcaaagattagaacagtggtttccagggactaggggaagggggaagtggggaggtgatgattaaagaacataaagtttcagttatgcaaaataaataagttctgaagatctactgtgcagcgtagtgcctatagctaaaaacactgtattatatactacaaatttgctaagggggtagatcttatgttaagtgtccttagaacaaaaaaaaaaggagtggagggcagaagaaattttccaaggtgatgaatatatttatggctttgatggtggtgatggtttcacaagtatatatttattctcagactcactgagttttatacattatatatgtatagctttttatatatcaatcatacctcaataaagtagtttgaaataaaattaaaaacaccccctccaattctgacctcagtgtccaaccttgcagtttcttctcccagtgacctctattaacagagcctacatggaaccagccggcaaagacaagttccactgtcacaactagagaaaagaggatgggtttggaattgaaaggtaatagattattaactggcataactatctgtgaaaatattcaataaatagactgtttccttcaaatccttgaatcatttcaactttctcagtggactttttaatcttggtttatctttactggcctccctttaattctggagcctttaaaaagtgtccagggttccttagttacttgttaaaaataagggaatgaaaagttgattggttgtgggctgggcttgtccattgatcaactttcctttagggtgtttggatgggaaacaaacatactgactgcccggcttttgtccataacatgcagtttgtatagagaagaatcttctgcctttttgctagagtggtaaatccctgggttcccacttcttggggtaagggagttggggggcaattttaaccaacactaattttcaattaataccttcattttctactatatgcttccaattggtgttttctgagcttctctgtatttctgcaaggccaatttactcagcttccatagaaaccatttgcattaatttcttgtggctacctgtaacacattgccacaaacttagcagcctttggaacaatagaaatgtattctttcacagatctggaggccagaagtcaaaaaaatcaaggtgtcagcagcctagagtttttgacttctggcctccacacctgtgcagccctcccttcagaggctcggcagggaatatgttccttgccttgaccagcttttggcagccgttgacattcctcagctggcagctgtgtcactccaaatctccgcctttgtcttcacaggcccttctccttgtctatgtaatctgctccctgcctcactgttaataaggacagttattgttgaatttagggctgcccagaaaatccagagtgatcttctcacctcaagacccttgacttaatgatatctgcaagactctttccaagtaaggtaacattcacaggctgaggaatgaagacatggacatatctctttgattaccaccattcaactcactacaccactcttctaactgcttaatctctttaggaaatttgatgacctttcttgtttgctaatggcctgctttctgtcctttttattctttattgattttgtgtatttctctctcttgctctttctctctctctttctccatatatatggagaaacacacacacacatacacatataaagtatatataacaacaaatatatatacatacacacatatatataaaatatacataacaacaaatataaaatatgtgtgtatatatgtaaatatatataataattgtgtatgtgaatgtgtgtgtgtgtgtgtatgtatcctttataaccacttactgggttattaggaataaaataatataaatgtgtgtggttagtccacaatcttgactttcacatatatagtttatttcaaaagaatttttactaggtaatctctgaataaaatcaaattaagctaaagtctgggaaagtacagaacaaataagttaggttatgtaaaagagcttaatttaattagcagtttatgtatctctcctctctcttgctctctctctctctctctagctctcgcctcttaatatttttcaacctgttctgtcatgattccacaaatattcaagtccttcatgtttccagggtaacagtaagtattcggcagtttatctgacaccttccatttaagataggaaaaaaataatagaaagaaaatgtcattaatgtatgcaaggctgaccattatgacatttggctgtctgttatctttacaaatacgttctcttctttcccatgtttctggttgcaactttctgaccagtgataggaataggtggcatatatgctacccacttctccaacttgctcttgtccgtgattactaattggttatataattcattttcggtaagcctggatataggttcaaaattattttctatacaatattaaggaggcataacaatttattggagctggcatgtaaattgaaaattgcttgctgtttatgctccaaactttctacctcacagatctcatgactcgaatatattttaccactacagttttctcccatagttataattttgtcattgcttctgctctaaccaagcagttagagaaggcagtacaatatagtcaaaagagcactagattgggtgcaaaaaagcttgagtttttgttctatattaattacttgtgttatagtggataaattatttatccttctagatctcagttttcttgctaaggcaataaggcaattggactatggtaattcctaagatacttaacaactctaaaaacttttaatatccagcagccaactagatatttccacttaaacgttacatcattacccaaaattcaacccatcaaaaaatcttaattcaatgccctaaaaacatctttgccccttaggtttggtatttctcgtactttgcactctaaattcaaaatcttttagtcatgtttacttctcatcttttatttaccttctatagtttatctattaccaagtactataaattcttccttaaaaaggcctttggctctatccattactttatatatcagctctcactactctgactcaagaatttatgttcccaataaacttgacctttcacttcccttgttagccttatttctagatattttatctgtttttgtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgctgtgataactggctagccatatacagaagattgaaactggacccctgctttacaccatgtaaaaaactcagcccatgatgaatcaaatacttaaatgtaaaactcaaaactataaaaaccctggaagatatcctaagcaataccactctggtcagagcaacaagcaaaaatttcatgaagacaccaaaagcaattgcaacacaagcaaaaattgacaaataggatctagttaagcttaagagattctgcacagccaaaaaaaaaaaaaaaaaaaactatcagcagagtgaacagacaacctacagaatgggagaaaatatttgcaaactatgcatattacaaaggtctaatatccagcatctataaggaacttaaacaaaattacaagagaaaaacaaccctattaaaaagtgagcaaaggacatgaccagatactttgaaaaagaagacatacttgcggccaacaagcatatgaaaaaagcttgatatcaccgatcattagagaagtgcaaatgaaaaccacaatatcatctcataccagtcagaatggctattactaaaaaataaaaataaaaagatgctggcaaggttgtggaggaaagggaacacttatacacttggtgagcgtgtaaattagttcaatgattgtggaaaccagtatggcgattcctcaaaatcctaaaagcagaactaccattgtgcccagggatcccattattgaatatctacccagaggaatataaattattctgccataaagacacatgcatgcaaatgtttattgcagcactattcacaatagcaaagacatggaatcaacctaaatgcccatcagtggtagactggataaagaaaatatggtgcatacatataaacaaatattatgcagtcataaaaaagaacaagatcatgtattttgtgggaatactgaataatccttactgtcccatgaagtaggttctaattatagataagaaaactgagatacagggaaactgagcaagttgcccatgatagctagtaatggatggagacataatgtttgaactcaggcagttggattcagagcctggattcctagtcactgcacagtgtcaatgcctgacagatagatgttacgaacgttaactgttatattaattgctgtacattttatcaactagatatccattccattctctccacagccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgtaagtttctctcatatttaaaggagagttatgccatatgctctcataatcatgcatatttccttgtccacttgccaaaatcctatttctccttcaagtctccttgtaaataccatttctcctttgaaggagattcaattctcgattccccagggtagactaggtattaatacttatgctatgctctaatggcctttgaacacacatgccacaatacatttatatatacaatgaatgctggtattttatatcccttttttatgataagcaccttaaggacactgctgatgggtatctgtcttagttgttttgtgctgttgtaacagaatatctgagactggataatttataacaaacagaaatttatttctcatggttctggaggctggaaagtccaaggtcaaggtgacagcaggtttggtgtctggtaaggacctggtcttcatttccaagatggcaccttaaactctgtatccatgccagaagagcagaagagagtgaacccattctccaaagtcttttttatagtggcattaattcattcatgaaggcagagtccccatgacccaaacaccttccattaggctccacctcccaacactgttgcattagggattaggttttaatgtgagttttggagggaacaaaaacattcaaagcatagcactgtccatctttgtattttcagtatttgtcacagcactctgcacagagtaggcactaactaattactgtataccttaactgactttcattctttctataccactcagaaaacatcaaagccatagaaacacaaagcctccctcccactaggtttttattttaatcagcagttctcaaaattttaagaaatgggatttcttggaaaaattcaaaatattttggggagaaaccacaactgggtttgctaataaatgctgatatctaagtactgagctaattctaacaaaattaagatttgattaaactgacctagaccaactgtgagacttgggtgggatggcagagaataacaagagagaacagaagaaggtactcttgggctgaccactggttcaatattcctagggtgcccttgctgtcccagaataattatcatgttctgggctttgttctatgagttatagctactccttttttcccacttgtgtttctcgcatctgaatctccctcctttaagccttatttaccctgttgataaagctaaacttctgttttatctccaatctcttgtaatttatttatttatttattttagtaatctcagacctcttatagaattgagcccctgttgtgttctttctagcctcttttctgtaaaactacagaaattctcccaatcttagcttagttgccaagttcctgcctttaatggacacactaactagaaaaagaacttcaaattgcctgcattgataatagcatagtggacgtgtgtgtgtgtgtgtgtgtgtgtgtgtgtgtgtgtgtgttttctgcccagcatccctttcctctagtttggtaaaaatacgttcattttaatatgaaaaataatcccctcaccctcttccattgcatgtggtcttacaggggatgtcagtgaaagagccctacccaaggcattgacacttggcctaagcaagaacaatccattatttctctgcaaactaaatctgaaatggtcttcaacagttaagatgttagtgatggttaaccatctttagggagctgccatcacagtaaccatcactaaccatcttaactgtttaagaaatgggatttcttaaatatagaacctagcccagaacatggtaattaactgtttaagatggttagtgatggttagcgtgtgctggcagctctttaaagagactattcattagtcctgaataccagattattggggtcgtcctgtttcctgtagtattctacttaatgcttgattgtttagctttttatttagttctgtgaaagactccatacctttccaataaattattttttgtgcccttaaattagatagggttggtttacattttaaaacccaaattgacaaatgtaaattccttgttgcagtgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctacttctactgcctgatgaatctttttattttaatctttactaaggtaaaacttacatattacaagagtcaccaattctaagtgtatagttcaatgatttttagtacgtttatacattacataaccatcaccccaatccagtcttagattgcatgcccaatcttgttgtgtgtattttccatggccattgatggatcctagtatcatgtactgcacgggctataccaatatcaggcccaagatgtgtagcagtcaatcctggaggtcttgtggtgcccttaaatataatgtaaggggagagtgtcagtgtggtggattcaggggcaattactatgctattgaagaagcactgccaagggccaaatagaaaagacactgggctcaaataataaaaatcagcaaggcagacaagaccacaggaaacagggcacttggaagaaatgccatagagtccagtcagctgctgctggatagatctgactgcttttcatagatgtagcacacatctgcttgatgacgtcacctgatgccttctatgccacatgtttcaacttcatttaatacaaattttttcacaaattagaattaacattttaaataaaaggggttgaaaatattaacagataaaagatttgccttggattgaatttttttattcctcctattaccattcattttaatgtgaacccatctgtgagaaaagtggataatttatgtgaataatgtaatgatgctgtattctcctagataatattatactgtttttgaaattatctcctgcccccattccaaacttattgatgaatggcactgtataggagtatcaaaaaactaagtttgcagattcctgagactgagtatagagggctgatgttaatcataagaagatctcatattgaaacagaacaactgcggtaaatttggaagagaataacgctttttttttttggagacagagtcttgctctgtcacccaggctggagtgcagtggcacaatctcggctcactgcaacctctgcctcctgggttcaagtgattctcctgcctcagcctcctgagtagctgggattacaggcgcatgtcaccacgcctggctaattttttgtatagttagtagagacgagatttcaccatgttggtcaggttggtctcgaactcctgacctcgtgatccacccccttcagcttcccaatttatcacttctttggaggccaacaaagtgctgggattacaggcgtgagcccccacgcctggccaagaataaagcttttaatctttcccctcccctgatctctttgctttctgaaataatctcctcacaaggaggtgaaacattgagtggccagcctggccttgctgttgcttctgtatatcccagcctgtcactcttaggagcacgatgaagatctataagtatctctactttggtccagctacacctccccttgaggaatatagattggaaagggtacagaatatgtttcctcattggtaatgttaaccttttatttcttctgaataatttaatatttgatgtgaaaggctattttttgaagtatcacataatgaaacaacagccctgaacaatatagacattagaagcatttttttcttttaccttactacatgcgttaccaaggaaacaaaagaaattggaaaacaaagaaaaccaaaggagatgtagcaatattgggggttataataactttgtgaaaaagtttcttgcagaggtaagttcagttaaggcacctaaaagcatcttgacaactgataactcacactgcatggtggatacaaaatgtccaatgaaattcccaagattttttaaagcaaatggtgtctgtttctcaccaaggatgcaaatccaaactgttatccaagtcttgttcatagtgctttctaaatatctccagaatgcattgatctttattatttcttgatctctgttgcgctttctcaagccttcacgacagtgtatgtcttccctggattactgtgatgatctcctactagactccctgccctcaatcatgcctctgtaatctgtagtgtgcatggttgtcagcaactctgttcatggccaccatacttaaatttttaaatttctcatgtttcagaataaggaaccctttaacttgacatattaggaagacgcttcatgacctaattcctatgtaatctttccaacatcatctctcacggctgtcctgccttatactagatgtgtcaaatgatgcaattacttcatttgtttatctacttagcaaatattgactaagcattcaacattgtcaggcactgtttaagtgttgcaatataatggtaatactttcagtttctagaataagtcctgggccttatctcttatctctgggcctgtgcatatgtttttctctctcccgggaactctcctcttccttgaaagtataaattctgctaagtgcgctactgccttacttctggtaaaccttctctattacctaggctgaattaggtgacttgctgggtcccctcaaaatacccttctctctcatgcatttatcatgctacacctttcacttctctgtctgctccactagagtataaacttcttaaggcaatatgcctttttcatttttgtatttccaagactgtgccttgcatattatagatgttatttatgggatatcctctgaaaaatctccaagtgagtcctaagatcctagacattgcctagtaataatttttccttcatgaggtagcagatggatctaatctattttttattttattattattattattattattttgagacagagtctcgctctgttgcccaggctggagtgcagtggcacgatctccgctcactgcaagctccgcctcccgggttcacgccattctcctgcctcagcctcccaagtagttgggactacaggcgcctgctaccacacccggctaattttttgtatttttagtaaagatggggtttcaccatgttagccaggatggtctcgatctcctgacctcatgatccgcccgccttggactcccaaagtgctgggattacaagcgtgagccaccgcgcccggtatttttttattgtttttaaagtgacttatgcaaaggtggctatgcctttttataaaagattagcacaaagggagaataataacatttgcaaattatttgcttgaagcttttatttagaaatctgttacatgtccttttttgatatatatatatatatatatatatatatatatatatatatctctatagatctgtagctagattagggagaaatttgggcctaaatttgaacttttatacaccaattaaagcaagtagaatttgtaatatatttcaccacaggccacaatttctgccctggagaaggggtcagatcgtggtctccatctaggggagcagttacctgatagtcacataaactgcaggtcaggcccctctgtggtctgcccctgttcaggttggatttccaagaaaacaggctctaaggagaaggtttgaatatggagatttatttaggaaggctcttgggatccatccttggggtgggagtgaacagatggggatagagcggagtaaaaaaatacagaattgggtggagggagagaatgaataacaacgctgccataataaacacctcaactaatcctatggggaagactggggctgggatgaccccagctttgagaggcaaagggggctgtgcctttatgctcctgcacagaccagtctcccaaccctacccaactgcaacttgatgaatgagggccctttcttcaactgtggtcaattcccaagaagggaatcagatgagtactgggggagtgctatagtttgagtgtacgtgtccctccaaaattcatatgttgaaacctaatcaccaaggtgatggtattaggaggtggggactctgggaggtgattaggtcatgggggctccaggtttgtgaatggaattaatgcccttacacaagagacttcagagatctgcttcccctttcatctccttcatcccttccaccatatggggaaacagagttcatccagtcctccatgttaggatgcagcaaccaggtataatcttggaagcagagacagaccctcaccagacacagtctcctgggaccttgatcttggaccttccagcctctaaaactgtaagcaataattttctgttatttataaattacccagtgtaaagtattttgttgcagtagcaggaatggcctaagacatgtagtgagtgtttcagttctgaaactgcaagtagagatcctggttgtggactctaagttcctaaacctcctcatcacttattgggaaagtcagttttggggctcaggaccattaggaaaattcaagattcctgcctcattcaaatggagggctaaatgcagggtaggaatagcaagaaggtattttctttcaagcccatttccctcttctttcaggctgttaaaacatgttcacttgttcacctgctagtggccattggctcagggaaagtgaatcagatcccttgttcaaggggataaatttagttactcttagccaatcatggtgattctattctgcttttcagagactggtttaacaagagtcatgtgatctttctggtcaatgaaagataaggggaagccagcctggagttgcttcagaaaggctgctcttaaacagaaacatatttgaagaaacagtaactttattctgactctttatgtgtgtggcggaggaagtgatgcctagagctactacaggcacttaggccatgaggagaaccagtgtaagtcagcaagccaagatgctaaagacagcagaataagaaaatggcaagaatcttgtccttgatgctgttgagctactgaattaaccagggctgcaactccctgtattagtaaggattctccagaggaacagaaccaatagaatgtatatataagtatataataaggaattagctcatgcagttacagaggctgacaaattccaatatctgcagttggcaagctggagactcaggagaactgacggtgtagtctaacggctagcaggcccaagaaccaggaaaagctgattaaagttcaaaggcgggaaaaaaaaacccaatgtcccaacttgaaggcatttaggcaggaggaattccctcttatttatgagactgtcagcctttttgttctatttaggctatcaattgttttgatgaggcccacaacattagaaagggcagtgtgctttgctcagtctatcaatttcaacgttaaactcatccagtataatgtttgatcaactatctgggtatgccatggttcagtcaacttgacacataaagttaaccaatcgtcaaaaccccctacttttggtttcttgataaataaaataatatttatcttctgttttagtggaataaaggtatggaaaacgctttgatcagtttctgtcttttgttgatctggaattgcagtatcattgtgattaaagaaactaaaatacagtgtaattaggggatcacatccaaattttgcaaaccctttggtaatgtttagaatatatttgattaattcattttcaattcaacaaacacctgttaaatactaactatatgtcagctaggtacatgttatatgtcaatgaaaaaaaaaagaaaaaattccccttgtggggctgacatctagcatataaacaaatggtcaattttaatatagttttgggtttatttaagcttattacagaataaaaaaatagtgccccaaactgaccactcttgcatagccatgcccagcagccaatactacataatgtcaacctacaacacagcaccatcaagttgttactcaaatgagacctaggcttgacgggatgttaggaggtccatttctatcaatcagagtctggagttcatccatcgccctaagcctgctattgagggagccctatgtaaacatttatgtggccaccaataaatagtaagcccctcaatcccaaccctaacctcactgtgtttctagattcttgcctctgttctttgtttgcactttattctttgctggtaacggattctagccctgaactccagccaaattgtctgggcctacgaattgactagtcttgccaacctcttctctctgggggatctggatcctatcccaattttctcccctctgcagcccactggctaaggccctattacaacccagacaacctctcccattccgaacataaaactgtcatctgttggataataacatttcccacataaccagttcctggtgccatgctcccacctggcttgagatggtgactgtcaccattaatctggtttggattcaggtttggtatgtcctgttagatgctgagacttgggggagcttatagtcatatacctcagacctcccctatccccaccagtcttggcttacttctctctctcctacagatctacagctggggttctcttctggctctcctgccaaggccaatcagatcgcaatacaaaaaagtaacactttccagcattctgtagagtctgattttctaaacagttctttagattttaatgcatctcaataatagttataagtaacattttatttttttctgtggcagattaggcctcctgcaaaatagtcattttcaaaaattgtctaagattcagatgccgcacccaatgtttatgctttttgcagcaatatggtcctaattcaacatcatgcagcgtgcaaatcagtgtttcttctaacttcaacagtgataaatatttattaagcctccactatgttcatggaactataccaggtgctgctataactatttttcctttccaggaaaaataaattcaaatatggaataaaaagcccaaactcatgaaactggactgactttgcttcttaaaaattcaacatgctgcagctgcatgcttaaacctggttcaaacaggatgatgaaataaaacattattattgtgggaatataacactgtctaaataaatagccaacatgaaaactgtctctaaaacccatagcatctgtatgtgcagactgtaagtaagttatataattcctccactattctgtaacatggccaattcagaatgtcttaccattaatcttgaagacatttaaagatgttcacttttctaactcttccctttgaaaatatatttgaaccttatttgcaataaaaatctcataatattgtattactttttgatgtgtcatttctgttaaatggtgcctggaataaatcagctttgacttttcagattacatgtgttgttccagagttttagtagttacaacatacatttacattttctaatgtcctcactataatgaagataaacacaggggtaatttttctcatgtcatgtgtatataggataagattaccaggccaacagtgtcactatcagatttctttcagaaagtgtttaatgttgaattttaatcacatgcttgaacaactaggactttttgggttttatttttcaaatatgtgttagtaagaaaacagactgaaatgtggaatgtaccagataaatctctttggtgattttacatatctgtatgatcatgtttgacttagaaataccaatcttttgatcttacacttcaaatgttacatctgtgaacataaaaatctatatggctataactttccaggaagaaatcttgctcaagtaactaataaatgatccaagttttagataattctgacataattccaacatatttcctacagtattttgctttagaagactttctgacccagatatttatggctaaagtccatattttatagatcaaatgataattaccttgtagaggaaagcatttgtttttgaatagtgccaggagcaagtaagtgtaactaatattacacgatagatatttctgcagataagtgagcttaactctcgtggttaaaacttatggttaaatttccacagattagtaaaagttctcagttttattaacaattctccattttcattaaaagccctactttcctgatagttaggctgatgagaagttagttcagagggctgctcattcccatattcatcactttttattcagtaatgttattttatgaataataattttcttatttgttgaggcgtatatcatgatgtttagatgtacattactatttgtccaatgcaactaattagttaaataggaatgagttgtaatgatcagaggtaatcccagaaaatattttttcaagtttacaaacttataactttataactttacaagttataaagagaccttcataacagttaattaaatcaaagaatcctttagttggaccataagcactaacagtcggcattccgtgaatatttgttatatgtttggtattttgctaagcacttcattttttttaagtgtcatttaattttcacatgaaccctatgaaatatgtatcattattagtcttatttaaatgttgctgaagctgatgcttcaaggaaaagtatcatgcttaaggacgaacagctaccaggtggggaaccggggacctgaactgggtaatctaacttaacttctgcttcagtatcattttagttatatctttcttgtacaagtatgtctcatcttccctgttaactcttcattgataggaaagaccatctttttttaatctttatgttccattacttgccttgggcacagtagagacctataaatgtttggtgctcacatttaataaaaatgtagtaataatagcactatgatatatagcaataatttttttttttttactttttaagggttaaatagggtcaacgtgattgactcacttgtttttgcttattgtacttaaacgtctaatatgttagattaactctattattaatgatttggccacgtaaagtcaacggctattctgaaataaacaaaatggtctgtaaatcccttggtatatttttgctgccaaagagtacaaacattcattcaataaatatttattgagtagaatgaagtgaaatccaagtgcaagaaaacagcaaagaagtaacagaggtgattgagaaaatagaaaacagtagtgagattcagaatgacagcagtggcttccactttagtgtaggtagttgaaaaaagccctaccacaaagttaaacttcagctgagactagacgggtgaggaggacatgaacttggccagtttgaaggtaaagatggatgatgtggctggagtatagtgaaattgtaatttctaccaatctaaaatccaaggcaagctttgcctgagccattccagacttccctggtggatatgaattagatcattccaagtcaaatgttcatgtgttgaaatctaatactaaagatcccttaaaaaatttttagactaatttcaatgaccttccattctggtcacttaggataatgggctaaaatagaaatccctctgaaacattattctctcttactcttatggttttctgtcttctctggatcaacacgaatggtactccctccactgccccaaatattttagccgcaacttggaagcccatggcacatcctgtgtgtattaaaagagggctccattgactacctggtaatgacagatgcttggttctccttggaaaacaattcttctaggtcactcactttctccattcaagactctgacacctgggtcacaatttcatcctctgctaaatcctgttattatcttccctgacttcaaaggttcttccacctctccaactccagtgattttcacatacctttgtcaccccacaaaatactggcaactgtggatatactctgaactttgttattccctacaattgtcctgccctcttacttccagctctctcctcagaccttactctccatagatgtctctctgacaccacagacatctcttatctcatggctctgttaccccagtttatctaccacattgttcttgtttatatccctccccagcttgaaccctataacttattgatggaaccacttttttgtaccaacatccccaaatctctgaaaccttggactttcctatgcatataccttggctgttgaacagtctcagaaaaaggtcacttggtatttgctaggggccaatataatatttaacttagctggagtctaatcaatgcttgactgtcctatgctttgttcttggttagtaattcttgccacccttcccaagaacttctttagattcctgccattcccccttaagatcctttttaactttttcttggtgccttggccttttattctactgacaatattgagatgttgaagaatgaaaactttcaaacacccataccttccctcaaattttgaaccagaatcatccttgactctctcccaccaatctcagtggaagctctcttgccttcttcccaaggccaggccttccagttaggatcttgattaggatactattctgtctgttctccaattttcttatatgccttcaacttttctgcttctcttcatctgtcttttcttaaggcttatggaactcccatttaaaaaatctttgaatttgtgtgcccctttaatgttagccatgtctgtatcagctaacctttatcagctgttttcagaaagaatagtctgcacttgaccaccaccacttcttgaattccccattcattcacctattaaaatcgggcttcctcctctatcctctgcgctgacaatatctggctaaccataattgatcttactatttttaaatccatttattttatttagcatactaacccatttcttgaaaccacctctttatttcattaatgccctcttctgtcatcgaaactctctgcctattgcttccttgtcccctttttctatcttttttctttgcataattcaaaatgctggtactcttggaggtcttttttcagcccattgctcttattactctgcatatgcttcttcagataggggcagacaggatgtggttctcatttaatttcacagtatgtattatcacctataagttgacgcctcagatctgctcagcaacttaggcttccaattggaaggaccataacttagtgaaataaacatactccaattactgaaaattttctacaccaggttcccctgccactctacatacttcctcacatgatggtgccagcatgcattagaaaccaaagccagaccgcttggagtcacttgaaatgccttccctcatgctcacctcatttagtcactacatcttgctgatttcacttctaaatattgctcctctgcttttcctcctactttttagctttgctgttactcctctagttcaggcattcatcttcactcatgttgattattgttttggcctcctttgtctgcctcatcttttctggctttgcactcacagtccatcctccttcttccatcatggctgtccatttaaagggcacatcctcctgtagcagagggatgacaaaaaaaaaggagaaggagaagatgaagaagaaggacaagaagcagaagaagcagaagcagcagcagaagaagcagaagcagaagaagcagcagcagaagaaagaagaggaagaggaggaagaagaggaagaggaggaagaagaggaaaaagaagaggaagaggaggaagaggaagaggaggaggaagaggaagaggaggaggaagaggaggaagaggaagaggaggaaaagaggaagaggaagacgaggaagaagaagaggaagaagaggtagaggaagaagaagaagaagaaagaagaagaaagaagaagaaaagaagaagaaagaagaagaagaagaagaggcaaatcccataacatcactcccctgattgaatccttaatgggtataccttcacctgcccactgctaggtgctgcccactgccaggtgccccatgcttctcttcacaacagttaccacattgattgcagtcctgttgcccagatgtagccagaagcacctcagtggccaacaccttgcctcactcattctacagccttggtacctgggatactacccagcacaccataggcattcaacaaatgttaaactaaacagaatagagttaaatggaatatataaccaaagttaattccatattggagaaaaacaaacatcatggcaagtaattatttggggaacacctaatgcataccagcactgtgttggaacttcacacattttatgctgatttactagacatctgtgttacacagcagggtgaagtggtgtaaggaacatgactttttaaagagaaagatcttgggttacatcctgactgtgccacttcatagctgtgacctcgagagaactacttaacatctaatttttaatatcgcactattcaagggatagcaatgcatttctcacagggtagttgtgcagactaaaagagattaaaaggacctagaaaatgtgtggaggttaaacatgaatgccactggggcttgaacctttctcataatttgacaactgctgagaagggcaggactttttggcatgttaaggtctctgagttcaggaatgaaggggcccccatgagtcctgagtgagacttgctgaggcccagcgatattgtgtgaaacaggatttaagagtttttactttccagaaaccaagggtaacagaagtctctgtattgtaataggaggtcatacctgcttaaatacatagatagtaatttagtatttgctggtgtaaatagtacagtactattggggatacattagaaaccttaggaacatttattaaatgaaatcataatagacaaaacccttcagagtgtgccatctcttttttttgctgtgacgctgacagctcttacactatttcaaagagatttggaacaaattattggtaacaataaagcccctctaaaacttttatatggagatgtttattgcaacattatattcaatagcaaataattacaaataacttatgagatcataaagtaaatgatgagtgatgttataccaatatgataaataaaatattatttatctctacagtaaggcttatgaagactgtaggaaatagaaataaagtgcccaatgtggcatgcatctaattccataattatagctaagaaaatgtaagactatctttggataagggctaataaaaaaaaaataggtataaggtagtatgcaaatatgaatataattaggtttgggcagtaaaatctactgattttttttaattttggaagtttacataattaaaaattttaaattattttaaatgatttatgagcatcagtatcagaatattaaaaatatataaaccaagataaatgctccaagcaagagaaaagcaattactgacttaccaaattattcttctgacatcttaattataaaacctagccataatttattaccagaccctagcttcccattcttataacacagaaaatattattttatgacttacaatcaaggcacaatctcttaaataatctactttagaatcaactataagcaaaagaaaatttatctacagagctatattattagataacctggtttgtagccttgcaatgtgtattcaattgcctttatgtctatttgcctatctcctaaaatactcaaatttcggattttagcctaatacactcacaatcatgagactgattacataactggatttcaaggagaaaaaataacaaagaggaatgaattaattatctgaactttagttatatattagatttcctaaacaagaattacagacaaatttgtttattaagaaaacactgttgagaggaacatgtctttggaattatgaaaaatgatcttccagagtatatggaaagtaaagacattctgaggaaatgtccattatgaaagtccaagtgactatgcttaaaccactataaccgtagatctgattgcttgatgctataattcaattatcttctcactactttacctctcatctgatagtgaaatacagccctattttttcctctagtatttattcaaatatttttccaagtatgacacaatgactttatctcctcagtcagttgtcattcttgaggtatgtagactcatcaaccactaaaccactgtggcgaggaccctggtccatttggccaaaaattctgcccttgttcttcatcctattaaccgtaaatatattaggaatctagctagaagatgtcccaatttattattcattatagctctaacaatattaatgttaactattaagtatgaagatgatttttttttattttccattaagtcatttattgagtcacttacattatgcctgtagtttaggtaggattaatccataatttcttcccaaattcccctgtgattcgattccttgcagaggaccattaaatatatgatgagtggttggaaggttccttcttatcctatggataaaaggctctaaatgtcttaatatatttaattcttcatttaaatcacttctgatgtgtgtttattatataggtaggctctcttgaacatatagtccagtgcaactattaatgctttatttattttttatttatttattttttgagaccaggtctcactgtcgccaagccttgagtgcagtggcaggatcacagctcacggcagcctctatcccccaggatgaagtgatcccctttcttcagcctcccaagtagctgggactacaggtgtatgccaccataccgtgctaatttttgtattttagtagagacagggtttcaccttgcccaggctgatcttgaacttctgagctcaagccatctgcccgcctctgcctcctaaagtgctgcgattgcaggcatgagccaccacatctggccaacactttattgataactgtatgtatgtataagcatttctaggttgtaacaatccattggctctcagtaggcccaccagaggagtactgcacctgcaatgaaaacctgtctcagatttcaatctgcaagtgttttattatgggctgctagtaaattatcccacaagaggtcgctaaagctccggtttttttgatgtgtgatttttctgactttttctccttcctgcaaaggaattgcaaaaaattttctgtttcccggttttctatttcccagtctgttccaacttgacatgaaggtagtcaagaattagggcttagtcatgggcaaggcagcttacttatggaagtttgtagccatctagggttgctcaaatccatcacgtgaacttcagagcatttcttaccacaatttatacttgaaaaggaaatacaaccaggcaccttctgacctcaataactaaactcttttagctgtaatgtagacccctttaaaggcacattaccacttttcaggccctgggttgacattccagttttctgcacataccagaatgatagaatagacatctaaaagaggcctgcactcagtaaatatctccttagagaagatctaataaataaatgctagaggtaccctcattaatggaaaattgctgctacatctatttctttggaggatttttagactcaagcaggcagattcctgtaaagaatttggtttaaaacaaagctgatattttagaaacaatctctattttctccacagaaaacataaatattttttaacaagacatttaaaattgtgttttagagaaaaatcggcttaaaatttgagaatattttcgcccatccttagaagaattttctcttccccttagaaaaatattgcctgaatataaaaagggaatcttaccttgatttctccatctctcaaatctcagaagaaacaatgccacttttagcattcttgactagtaagattattggctatatattttcttagcaagggtcacatgttacatttttaataggttctattacatagggcagaggttataggcaaagacttctctaatgatctttccacttcccttctctacggggaatatttaacttaaaatattgtgatttaatcatatataaagagagaagtgttattgtgaatcaagcatttgaacaattttatgttttcatatgaatatagagtgttaaaattataaataacattttaattatacggatggaaaaacctggaaagatctcaaccctatgaacatgaaggatttatacaagatgattttggaatcatcccttctagtcctaaaatgtaatgactttccttaaattcttatgcttttggactataaaagcccatttctattttaatgagataactttaagtggagggcttttcttatttgaatagctgtcctgttacgatttgggagttaaatatcagataattaaaatttagttgtttacagttactgagatttttgcattatttcctcagcaataattttttatatttacaacctctatgttaatgaacacactatttcatgaagtgcttttgtaaaatgctaacataattctttcctcatgtctttttggaggtaggagactcatatactttttatcagagatgctcatgaacttgaaggcccaaatgaataataatatacagataatgaatttctacttgacttgagccatatcgcaataaagaaggaaaaatgaaacaggctagccaggagggtaggaatagaccagtcacaatgcatcaaaaggcaaatgatagtaatcagaatctcaaagaatcatacaatgagtctttttaaaataccaccaccacctactccactactctgggcttgtgttagctgacaaggcacattggttttcccgtttactcacattaagccctgggtaggcacaaccagagaacatttcaaatatgtatgggttatgaataagtgtgagtcaccgacttttagtccagctgaaactacattgtcagaagagtattaagctggcatttgcaacccacatacttaccttgtgcctgacactgtgttctgtatttaggacaaaggcttttctagtccatgcactcaggtaactcacaatacagttgaagaaaagagataagaacacagacaactacagtattgcatcagtactaaggcatgcatagcacccccacccccagctgtcttacctcttggaaatcaggttgcatcttacaattgatggtatcttgcaaatgccatgtctaggctgctgtcataagcagtcttggtttgtgtgggtgcaaacttggtcatagctgttgatcttgtcttcccttcattgaggtatgtgcactgttgataatgcatgagttgagtgaattgccatttaaaatgctttaaatgttaccttataattcagtattagaaaaaaaattgtggtatgtgcaagaagggctagaaacagtgcagtgggatgtatatttaatgtcactgaggtaaatatttaccattggaaggatgattctcatttcttattttcttgcaaacccataataaaataataattatgggttctaagaaaggaaaatacatgttgaataagttgtgtaaaatgtggtgactatgctatgtgtcaaaggattgtctatcaccttgctacaaccaagtgtggtctctggatcaggtacagtctctgcatcaacattacctgagaagttgttagatttggagcatctcaggcgccacaccagacttacaaaatcagaatcttcattttaaagtccgtaaatggttcatatgacataaaagtctgataaataattatgtcacatgccaagcaattcaatgaaagtcaggaaaaattgcctttgaagagatgaaagaaatttcaaaacaacaaggagttgatgtgaccaattcactcatgcaggactatcattaaggtgtcaaacttcaatatcagaaacttcctgctgagtttgaacagcagttgcctaacttcgtgtgacatgtattttgattgaagaaaaatgaaaacgatcagtttattgaataaaaaatgctaacaaaccatgggctctttgatatgtctcagaatcacactaaaagaaccctttcaatacatataaaataaaaattctaagtgataaggctgtgtaataattttactggcagctttttttgttccttgatgttacataaactaatagtgtgttttataattgatggtggcatagacttgatgaaaaacagtataatacagtgtgataggtgctataataggaagaagtgggagatgctatggagtaaataggtggtggtcatatctcataatcaaggtttgttaccttgagcaaaagtcagtcagatggagatgggaatgaattgaggtgggatgcagggaagttattattccaagaagagagaattacacatgcaaagccatcaaggctgtttgtcaagaagcaggtagagggattgaatcagtttttaggggatgggggagttgggatgctggattgtgttttgccttagctttggtgttacagagcaaaagcaaagggaaatagtacctccacatgtcaaaggaaaatttggtgtccaaaagctcccattcccgctaggagaactgaccttgtgtattagggttctctagagggacagaacgaataggatagatgtatatacatacaggggagtttattaaggagtattaactcacacaatcacagggtgaggtcccacaacaggctgtctgaaaactgaggcgcaagaaagccagtccaaatcccaaagctgaagaaatttgactctgatatttgagggcaggaagcatccagcacagaagaaagatggaggctgggaggctaggccagtctagtctcttcacgttcttctgtctgcttttattctagctgcactggcagctgattagattgtgcccacccagattgagggtgggtctgcctttcccagtccactgactcaaatgttaatctcctttggcaacaacctcacagacacacccgggaacaatactttgcatccctcaatccaatcaagttgacactcaatattaaccatcacaccttgtctgggatcagttttgtgtagaattaggttcacggataaagttagctttgttctcttccagtattttcttgaatgaggatggtttccacttaaggaataaagacattagttttgatggctaagaatggagttttcactcaatcctgtctgcacattgccatcaccccaagtaatgccttagccacactcacagaagtttgattaacttgctatggagaagcatgagcattggtattttttatccattgtctccatgatactactgtgcagtttatttaaaaaaatgggcttatggtcagggagggttagggcagatgaacagctggtcagcagaaaacaggaactgcagcacctataaggctacaaatgaagcaaagcatcagtcaaacacttggcctcttaggggaaaccatttatttgggcagatatggtagggaaatgcgggataaatttctgccatcatatgataagccctaggatttaccaaacaccttggatcatcttggaatcctctcattctaagataacagatctctcttctggcctcctatgggtgtttggatataaaagacagatacacaactttcacatccaggccctcagatacacatttcccagggtagccctgaggtggtgctgctgtacttgtggtcacatcttggtttgaaaacgctggtagagagagtggaacttttcccttcttttcacaaagagtatggggcttttgcaaggccaaaaatagaaaaaaaaagcctaaagttggtgcctacatgtttgtgtggagcatttaagctcaaacagggcatatatatgttgggtaagaaagtggatattcatccataatgacagtatactggtgatatctctgctatgtcttgacataaataggattcctatagttttaccttgctcagttgcaggagtgggaaaggcagctgagtggggaaactgagtcaatatatacaatgttaacagtagacttttgagccaaaggatggggtggacacattcaagaatgaaaggaatagtgggtttgcaaccgtagaggctgagagcaacattaagtaacaagtcacagacagcactgttctctcaactccctctgtgcagtgctagtgtatatgagtgggggtcccctgataatgtctactcacacaggagccagcttgagtcagtggacagctgggctgaccctacctgcatttgtacttcaaagctatgtgatactttagtgtattataggctgcacttggaggtgtgttgttttgaagacagatttgtggcacaaccagtggaatattctctgcccaagagtggcggctgaggcatctagcttattaaaaaggcctccaaactggtctccctgcctccacccttgcccctcacaactctactctcaacaaaacaatagaaatgatcacttgagaatcaaactctgtcttctctactcaaaaacccttctatggctcctctactcaggctgaaagtcaaggtcagtaccatggcctctaaggccctttgtgatttgtgtcccctcccctactcctctgacttcatctcctcttactggtccacacttctgccccagggcctttgcatttgcttgtctttctgcttaaaatactcttccctatatattttggggagctcattcttcttctcctttaaatctttgtttgagtgtcatctttgcagaaaggctttccttgaccaccgatttcgatttaaagtgacatctgactgagccagaaagaaatagattccctgaatagataaataatgagctctgaaattgaatcagtaataaatagcctaccaactaaaaaagcctcaggatctcatggattcatagtagcattctaccagatacataaagaagagctggtattattcttacagaaactattccaaaaaattgaggagggacttcttcccaactcattctatgaggccagcatcatcttgataccaaaatttggcagagacacaacaaaaaagaaaacttcaagccaatatccttgatgaacattgatggaaaaattctcaacaaagtacttgcaaaccgaatccagcagcacctgaaaaggttaatccaccatgatcaagtaggcttcatctctgggagacagtgttggttcatgaataaatgtgattcatcacataaacagaactaaagacaaaaactacatgattatctcaatagatgtggaaaagacttttgaaataattcaacatcccttcaagttaacaagtctcaaaaactaggtattggaggagcatgtttcaaaataataagagccatctatgacaaacccacaacaaacatcatagtgaacaggcaaaagctagaagcattccccttgaaaactggcacaagacaagaatgccttttctcaccactgctattcaacatagtattggaagtcctagtcagagcaatcaggcaagagaaagaaatgaagggcattcgaatagaaagagaattcaaagtatctctgtttgcagaaggtatgattctatatctagaaaactccatagtctcagcccaaaagctccttcagctgaaaaacaacttcaacaaagttgcaggatacaaaatcaatgtacaagaatcactagcattcctacacaccaacatcaaccaaactgagactcaaatcagaaaggcaatccaattcacaattgccacacatacaaaataaaatacctaggaacacagataagcagggaagtaaaagatctctacaatgagaactacaaaacactgctcaaataaatcagagaagacacaaacaaatgtaaaaacatcccatgctcatgggtaggaagaagcaatatctctaaaatggctatactgcccaaagcaatttccagattcaatgttattcctatcaaactaccaacttcatttttcacaaggctaaacaaaattatttaaaaatttatgtggaaccaaaaaaagagcccgaatagccaaggcaatcctaggcaaaaagaacaatgcaggaggcgtcatgttacccgacttcaaactattctacaaggctacagtgaccaaaacagcatggtactggtacaaaagcaggcaaatagaccaatggaacagaatggagaccccagaaataaggctgcatatctatgaccaactgatcttcgacaaaactgataaaaataagcaatggggaaaagactcccttttcaataaatggtgctgggataactggctagccatatgcagaagattgaagctggacctcttccttataccctaaaatcaattcaaaatggattaaagacttaaatgtaaaacctcaaactataaaaaccctggaagacaacctagacaatactatcctggacctaggaatgggcgaagatttcacaacaaagacaccaaaagcaattgcaacaaaagcaaaagttgacaagtgggatctaattaggtcaaagaacttctgcacagcaaaagaaactatcatcaaagtaaacagacaagctacagaatgggagaaaatatttacaaactatgcatctgagaaaggtctaatatccagcatctataaggaacttaaacacatttacaagagaaaaaacaaccctatcaaaaagtgggcaaaggacgtgaccactttcaaaaagaagacatgcatatgggcaagaagcatatgagaaaaagctcaatatcactgattattagagaaaagcaatgaaaaccacaataagataccatctcacatcagtcagaatggctattattaaaaagtcaaaaaataacagatgcgggggaggttgtggagaaaagggaatactttattacactgttggtgggagtgtaaattagttcaaccattgtggaaggcagtatggcatttcctcaaagagttaaaagcagaactaccatttgacccagtaatcccattactgggtatatacccagaggaatataaatcattctaccataaagacacatgcacgcaaatgtttattgtctcacaataccaaagacatggaataaacctaagtgcccatcagtgactgactggataaaggaaatgtggcacatacgcaccatggaatattatgcagccataaaaaagaatgagatcatgtcttttgtgggaacatggatggagctggagactgtcatcgttagcaaactaacacaggaacaggaaaccaaatactgcatattctcacttataactgggagctatatgataagaacttatgaacacacagaaggaaacaacagacactggggtctacttgaagggggagggtaggaggaggaagagaagaagaaaagataactattgggtactctgtttaatacctgggtggtgtaataatatgtacaacaaacccctatgacatatgtatatctatgtaacaaaccttcacatataccccaaaactaaaataaaaattaaaaaaattaaaaaaattaaaattcatgaaaaaaaaagtgacacccaacacttcctaacccatgtcactgctttatttttctattttcttcattcattcattcataagttccatgagagcagggctttttctcttttgttttctgctacaggaacagtaagtgcctagaacaataagtggtgattaagaactagctccttgctgaataaatgaaagaatatgtgtattatcccaaaccataatgtttcttggtgtcagtaacactgggagtgggcactgaccacgtggtccacatgcagaatatgcacagctatcctcgctggtgaccttcttgctttgtggatgtcaaagaaagtagacagctatatggactctgccacctggataactctagaggtgagtggtaggggttatgaacagcactgaggagctgggagtggctgtttgttgggtttctagcttcaggacaagttctatgagtttcctgagccctcatgatctaaaactatgaagcatgatggtgctggggtgaatactcattgtgttgcttgctcggtactcactatcctaactttgttctgaaggacccatttctccctcactctgtgtgtttcaagtaaaatatgtactgaagaaaatgccacctatttttataaatactgtgaactaagaatgatttttatatttttaagtggcttcaacaaaaatcaaaataataatatctaaatttcagtgcccataaagttttattgtaacttagccatgctaatccatttatgcatggctgcttttgctctacaatggtggaggtcagtagttgtgacagagaccatgtggcctgcaaagccataaatatttactatctggtcctctatggcaaaagtttgccagcctccacctcagactgtcgctgtggttagagtcctatgatcacagtgggtggttcagcacaagacccaggtttaaacgtctggtcttttctttgaactacttgggaagctagctctagctagctagctagctagctagctcttctgctgcctcaggtgagaaactgaggatgtcaggaagcatcaggcagcccctaaggatgaggtcgtaatcaagcttgattgaaaccattccaactctagaattttcagctgtgccaatcaatacattttctttaatcttaaattagctagcattttaagatctttgttgcttacagccaaagaaacttaactgataaagtcatttggaagaaatcctactccaggtatacagggaacagaattaatgagttcccaagatgattgccttatggtggcaacagcagttgcctggcagaagataggaaatctgtcttaatagtgccttctaggacccaaatttgtcctgctctggtagaaatcctagaagatcaggaatacaggagatgcaattagtgtttaggatcttcatttaacagcacacatctgtgtcttcccttggcataaatactgggagaatgcagtactcaggatttttatatcctcttattggaattacccacataatatatgatttattgcctatagacttctcaatttctatgtacacaatagcagcactaccatattttttaattcaaatgaaatgcatgaagatgtttgggtagaagtaatagaaaagtttagtaatgaataatgtttcattattctgtctattttctgaacatcagtcattatcaaatatagactcataatcaaataataatacatacacctacaatattttgattatgatgtttttagaaacatacatctcttttccctcctactgattaatctccttgctgtttaagcagcaaagctgctttccactcagtatctcagggaaaggatatgacatggtagacaacagaaaacaaatgaaacaactcccccacactccccaaattcaggaaacttcctggcaaaaagctcactcctttaggacaatagagagtctctgggtagagccaaattatataagagaaacatcaagggtgactgttgctttcgccttctggagaggaaaagattcccaggggtttatatagaaaaggaaggggaaaagagggaacagggaggatgtggtggcagtgcgtttggatgggtttcaaagagggagccccagttccatcaaggaccttggagcccctggaggcttctccctcgggttctgtggggccaaggagaggcgtcccctcaatcccacctggattccctgctggatcagccctagaaggaagcttcctggggctgctcccacttctgcttaagtgtggctacaccgtggagggtgggtccttaggaatgtggcaagggcagcaagattgagggggccatagtggtgcgggcatgtggagggggcacaggctttggcccgcgggcctgtgttcctatccctccctctgtcgttccctgtgaccaatgggcggagggcccattcttggcagaaacccagggaagtggcaaaattcccagacagtgttgtgagagcagtagaatgttcacaacctcctacccttgccctagcatcagggtttgacagaaaaattagattgaatgaaataaaaatatttctcacccacttgcgttcatggatggagattgatgaccttctaggtcagacacatttgtttccattagtgtggaaaatcaagagttgacttcactcctcagttcttccaagggtgacagttaaattttggctgcacaccagcagccaatggcatgcaagtgttagagcaggttatctgcatttcatgtgctggattttgcttcactgcaatgcactattgttcattttgaagaactgctttttcttcatttgattatgaagtccattcttcactgagaaagggtgaatcactgggtttcattatggagctcttgaagttcagggagagcgattttcatactaagttcattttctttaacatataaccagtgaaataatagaacaaaaatacatttatcttttataattgtttccctcctctaagacataacagtattaacataacagctatactgcataattcttcttcaaccaaagaacaagaagattaatctattctatttatttataaaatctcctgatatttctgatactggtttttcccgtcattcacctggtggaaaaagcaaggtggggaaataaacgatggtgacagctttttgctggcaatgcagaatgaggcccttgatgttattgtggcccaagggaaagtgtgagtactatattcatcagcagttctcaatcgggctattttgcacattaggggctatttggcaattttgggagatatttttgattgtcaaaactggtgaggtgggtaaggtggaaggtatgctactggcatctagtgagaagcgagatgaagctaaacatcctacaatgcagaagatagccccagcccctggcaaatagttatctggcccaaaatgtcaataataattccaaggttgagagactctgatataaagtaatcaggaaaggaggaaagatctgagtatgttaggatgattggcagggtttttgcagactgagaagagccatatggacatttgttgaaaaagggggaaagagagacacctgaagagttggataattcttttatactatgtaaggcatattttaaagggctaccgtttttagagggtacgttcttaccaactttttaaggagaggataaaattctgtgaaatcaatattatggttattaaaagcacaaaaggaccataattgtttcatgatttgtcttgctaatttcacatactatgatgttttatgtgctgagtggagataaatgtgtaaacaaaaatacgaaggtgacaaagcatggtatatttctacctggctaggttgtataggccagtgaatgtctaggggaagggtggtcctggagccaggtgagagagatcttgaatggaaagttacagagtttgaatcaattcattagaaatggaggcaggtgtattatagggttctccaggtaaacagaatcaatagggtggggagggagggaaagagagagagagagagagagagatgagagagatttagttttcaattgagggagctggcaagtcctagatttgtatgacgggcaagctggagattcaggtcagagttgatattgcaatcttaagtctggaaactcttctgcatctggaggcagaattctttctgagggcagtgagaggcaatctattccatacttctcacccagcttcttgttgtttactgatcatttttggcgttccttgtagaaacatcactcttatctctgccttcatctcatatgatgttttccctctgtggttgtctgtgtataaatttccccatttttttctatagacaccagttatattggattagggctcaccccagtgacctcatgttaactaattatagcttccacagccttatttccaaataatgtcacattatgaaatactgagggtaaggacttcaacatatgaatatgtcagaggcagacagtttcacctgtaacagggggtttgcatagagcagtgacattttctgaattgttccatgctggcaacattgcccagttttcttctcagggacatcagttataggaaaatgctatagtgaaggcaaatgggacagaatcttaaaatatttgtgaatctttgttttttcttgttctaatgataatgtaaatgtagaaaacactaacacattgtaaaacacagaaagcaaaataggtattatactgctcagttatgatactgctcataacccaatttatcagtaatagtatgtctatatttaaatatctaaaaggactattttttaaaaaatatgggtcttgctactttgcccaggctagagtgccgtttggctattcacaggtgcaatcatagttcactgcagccttgaactcctggcctcaaacaatccccccacctcagcctctcagcctcacgcgcagctggggctacaggtacgctccactgagcccagctatggaatatctatttttaataaaaatgtgaatcatagcatacgtactgttctgttattatcccttgttttcttttggacattttggacaccttttcgtgtcagaacataaagacctactaattcttttttatttactgcctagtatttcattgaatgaatgtgctatatctgtttaaccaatcccttattgagtgccatttgggttatttctaaatttttacttttacaagaaatattacagtgaatgtcattgaacatatatctttgtacagtaagtaattttttttgctgggtatttttttttttgctgggtatatttttagggatagaattgttgagccaaaaggtgtgatcattttaaactataacagacatttcaaatgcaaaaatgctgcatcaaatttttttccctcccactaaaaacatatgaattagattagtaattcctacatagaaagaattaaatagactacactgatagtgtatttaatgacactatgccagcacaataattcctgtaataatcaaagaatagttaccattgttttattaatatacacttatttgtcctccatagagctcttgttaataaatcttagcttattgctaagatttgggacttcttccagatggagtttatgattaaatgctaatcacattgttaccgaagtgttcagctttattcattatttgtttgatgtttgccataaaaattacagcccttataacccattattttggtttcaacttctcaaaataaattgaaatatatgttaaaaacttaatgtttgattactgtttaaaatgctaaaaaatatgatccaaagtatcagtgcttagaactagaaaacccaaatagctttaatcctttttgggggctttcttttcacccccgtgatgtgtgggtgtgtcaaacgtggattccttcctgttgttctgtttgctggagcaaagaatcatgtcttgataaattcacaagactagtgaatttcatctagtgtaatattgaggagtccagatcatggagaaggtgtggctaggactggtaccccccaaatactgtcatctccaatcacaattctggaaaacagtttgatataagaacatcaatgaaatggtaatttattacaccagtagagtggagctcagctatggagacacaaagcctggtgagacttggaaatcctgggcttaggccgtcagtttctggggtctgttaagaggatgcagagtgccagccacagagctgagtgtcagagaagggctatagaataggggaggaggaatagaagagccacttggtgttcttgttgtaggaggcacattaacacatcagaaatgttccaacagagaccaagctaacaaactggagaccatgaaatgcagatagtctctggagactacacatccaatgtctgaattttctaatttacttttcaaggcaaagtcattgataccatgtttttctccacaatatttttgcctgtaccaaccaagagataacatacggcacttcctaaaacaatacgattgccttctggattttcttccaaatcagtgatacctgttctccaagttttgatgatgacactgtctttagcttatcagaaggtggccatggaagatgctcagtcaacgagcaagattcatatttcttcctgaaatggttttgaaatagttgttgcgggaaatgtgaagggattgtggtcatgcagtcatgtcaccagaaataaccaaatttatccgcagctgttgtcagatacaatcaatagcaagataagcctcaatttcaaagatattaaaatgtgaaacttagaattgaatgaattattaaaatgtgaatcttagaactgaatgaaatatagtaatgtgaaaaaatttaaaatcgaatagagcttttttttaaaaacatggatcttgctgtgttgctcaggctagagtgcagtggctattcacaggtgcaattatagttcactgcagccttgagatggcttcattaattatttcctttaatcattcagcaaatattcactgaacatctttatgtacaagaccttgtggtaaaacttgccacccatttttatttgttgcttatgcctccttctaggtttcttaattagcttagctaatagtttatgaaatgtattttttattccaaagactgaactcttctatttctctattagttctgctattttctatttcattatttttgttttaattcttgtttcctttcttttatgtttttttacaactgtttaatttaaatgtcttataaacttagttgtaatcttaattatttagatatataagtatttaaatacatacatttctctctgctctagccatatcctattatttctattatgtggtatttgaactactggtatttcctagatgccttactattttgatttagagtttttcctttgatgcaaaagttgtgttagagagaaattaaacttacatgtagcagtatattttgtttttctaattttgtgattaatttctatatttgttgtagtagaggatgttatctacatgatttttactttcaggaatttattcttttttttgtggtttgacatatggtcaattttgaatatgtttaatgtgtaattgaaaagtgcgttgagtttgatttaaattaatgtatctatcttattgattaggtcatttggctcattattttttcttctacttaatctgtatcatgaagagatgacttcgtctcccatatttacttgtgtttctgtgtttctttttgtatttcttgtttctatgaatttttttattatttgtgcacaaatactcataactgttagatttttattgtgggttgtaggaattgttccaaagtacctctctttgtcatattttgcactttgtgagttgaattccacattgtctgatatcactatcttgaccctgcttcattttgtatttgccaggtaggtctttattgattctttcaactttcccatgccgctttgtttcaaacttagcttttcagtacaccatgttttactctgtgatctctttttcttttattacctttctatttattttctctaaaagatatagtctttggtttctaataggtatttttaatagcataacatagctacacagagcattatttagactgtacatgagttacttgttttaaacaacaattatcccttcttcccctgacccctcaccctccctcacaaccaccttcctatttggatgagtcctctgtacatggcatggccaatggagtccacagactgacctgtcactgccatggccacagcagttctacattcaaatggattcatgttcactgcctccacttttgccatagcttcttcttccttttattgaatggttgaagtttgtttctttaagaagtcttcacgggaccatagttcttaaattcatccatgtttgaaaatgtctactgtttgtctctttatgcctggagaacactttatgcctggggaaaactttatgcctggagaactataaaaatctctgaagtgcataatcatttccctgaagacttgacagaaagttgaaatttatctgatttttttcccttatagatgaccagattcttcctttatctttgaaattttatatattcaccagaaaagatacattaccagtttgatcgctttcatgcatttttgctgaaacatcatgtgacatttgaatttgtagattcaaatatttatttaaaaatgatttttaagttatatttttgagtacctttctgggtcttattgttttctgtttcatggaccctaaataaatgtatacttcatttcttttgtctgtcttccttccatagctttactttcctctctagtccttttaaactcttttggtttggcacagtattctcaagcttgttcttcaggtccttgaatttgttctatctgtcctcctttccgtgatatctaaatgtgacattcatttttgtgatggtcttattttccccttccatttccacctaagttctagcatttacagaggtggttctttcattaagttctcctatccaggaggacagtttaaagttttcatcagcttcatgacaatacatttgaggtatgtgttgtgggcttgtatctatttttggaagaggttgtatttcttttcttttttaagagtgtttttactttgatctcatgctttaaaaaatatctgatctttgaatgagagaaagtctttttctcagctcttagttgaactatagaatagtgctattttaccctaatctgtctctaatatgattatttacaatggttcaaatgcattttcagcagaaaaattgtttttttgaataagttccaaacttgctttccttattaaaagaagctagttggaacttgggtctgtgtgcttaatttttaagcaaaatggagcttttgctcaaaatggagcttcactgctttcattggttataaaattgaacctcatgggaagtgtaaacataaaaagcataaagaagaaagcaagaatcacccataatttttaccacttagagataatcaccatcattttgatgtatataagactgtaatttttaaagtatgtaaatttatgtgacacatgtttgtatatatagtgtgtatacacacatacacagataaatggcagatatttgcatgtgtgtgtatacacacacattcatacatatatgtgtacttagtatatatatacacatacatgtgctcatactatacatacgtaataaagtgatctaactttgctttttccctaaaggtcagagctgatgttctcaaaccttgcacagaggtcagccctagggcacaagagcaaattcatagggtgggtgccatgggaattgaaaaaagttttttctttattttctctaattctgatcctgaccctgaccccaaaccctaaccttaaccctaaccctaacccctggaattttaaaattattgagaaaaatatagtgaatgctagatgaccagttagtgggtgcagcgcaccagcatggcacatgtatacatatgtaactaacctgtgcaatgtgcacatgtaccctaaaacttaaagtataataaaacaaacaaacaaacaaacaaaaatatagtgacattgatatcttttagatactttttgagatactaaatggaagtagttcattttatagttctgtctttagattgagctatgttcctttcaatgatgttatctttgcaaatctgagttgatgaaattaaaagcaagtaaataccctgtgaaaattatctgggaacaggaaacgagggtggcagtattcattctaagtccaaggcttgagaaattgtgcagtgcccaacattaaacagatcccattaataagtaatttggttaagaatgacataaaaataatatttcaatttatgtgtattatttctttcaagcatggaaatctgtgcccggcaaaaccctcaatcaaatatatggcataaaaaagatatttttagacccctaagatcttaaaacagttacctctcttctaattggtctaaaaactttctcaggaacctgttggagaatgtactccttggaaataaggaagaaagaggatccagggaacaggagtttcaccacagaggagcaggaaagggaattcccagtatgatggcaagttgctaaattaaatgttttgcccattattttttactgggctgttggtctttttcttattgacttaaagaactctttattataggagataaacctttgttgtgttgcaaattatttcttgaaatgtttttacctcttgaatttgtctttgagtttcttttttctttgctctacagaaacttaaaatatttatttgatcaaattgattaacgtaaggataattttaactctcagatcctgtgaccctattaagttagatactataacttacagaaactaagccagctgtctgacttcttcggactttagatttgttatctgtaacatgacgagtcttctgctagctatttgtgaagtcccttccaactgtgattattgatcagtattgacttcatgtgatgggaagcttttgacaacaaatttaaattagctcctggaaaaattctagaaacaatcaacaacaggattttagataaaaccatgatattaaacatcataaaaccacaaaatatacagattgaagtggcagaaaaattcagtgactactgctgagacgacatggagaaagaacacttcctcattttgtctgaggcctggtgattcaacggctgtgtgaacggaaggtagggcatcagcaggcctggaaatatcaaactggtctctaccaagcttctcactagcaaaaaggaaagagacgggaacttgttgaaactccccctgcagcatgttttggacacaaacatttcttattgtttttttttcttttttttttctgtgagtgacaactcattcacaaaagagaaaggtgaccagagagctttgaaactcattcacaggctatagggaactttcctcactctctgagctcctccttagctcaggtaggagatggggaaggagtaggtgataaaagggagttcatattgccatgcttttgcaactctttccccttctccctaaattgctaccccatggaactttggttcatctgctgtccttatgtaatgctctgatctggatgcagctttcattagcaatatctgcaaacaggaatgagacattgcatgcatttgttctgaaatgatactaattttaaaaactatctgcaaataaatacaagtgcttctcaaccagtgtacatctttcacattgctttgtccagaacatgatcagtgaaactaaatctctagcctctgcactagactctttttaaatttttcatattttccattgctggttagtatttgttctcacatgtatatagagataaaagcatcacagctatatagcttgtgaagatttcgtttggccctgttgaaaattacacagtcagaaccatttcattagtatcaagcctctgtcaagatgtatggttagaaattgagtaagcttggaaatccgttgtatttgcacacatttgagacatccagtggggcaccagactataaaatagctggcttagcagactaaatggagtaaatgcattaggtttttgcatttagaatctaagagcatttagaatcatcatagatgagttccaaatgagaaaaataatatatatgcatttaaagcaaactaaaacgtattagagaaactctatgtgttagagtaaatattttgatagtcattgtaaagctgttttaataatgattttatatggccacatgatgccaattacttaaacatgctagatatctttcattgtaaaaataatgcaaaaatgttacaaactattcaaatataaggaagaacacagtgtgactaccttaacacaccgttgtgtacatttttctgtccatccttacaggtatttgccttgtgcagattttttacatagttgtagttgtataattcaagcacctttttgcattggctgcatttttacaactttatttataaaggtagaaatagcaacaatctttacatatttgtagtgtaacttgcttaaacattactcttatgttggatattcttttattttctattaaaatatcactactataaatatatattcatatatatacacatagaaaataattttttactcaatttagattatattaataggaagcatgatttcaaagttaaagtgtaacatattttttatggttcttgatacatatagctaaattgcttttggaaatgattgtacatatttagaatgcaattagcaatgtataaaactgccagtttcactgcaccaccatcaaaacatgatttcttcaataaactatttaatagatttaatacttaataataccttcctgggtttttttggttttcttttgttttaaattaatgccttggcagaatagggtcaatgctgctgtggaaatatagtcatggagcaagaaattcaagacttttttttttttttttttggtgtagtttagcaggaaaggtgcagagagtgtgagaaagaagccatttcatctgggtgcgtggtgaagtatagaagggttcctatttaaaaatctagggtttttctcctactttttaaaaatttggcctattctcctatttccttatgactgtgtaaagaaaaaatccccaccacctgccactttaataagaaatgtactattttgttccaaagggcacttgttttgcatgtgtcagctgaagacagaggctcatgtgaagcttaatctggacggaactgtgcagtccctaccaccatcacagctctagagccatggaaagtccaacaactaatttctgggcacagtttactgaggaggaaacttttgattctatagtctgtctttggggactccagtagatttttttgaagtatgtttaataatgtctggtacgtggaagtcctgagacttcaaacagcctcagaccatttggctcttggtcagttagagcaggtgattcaactgcttctgcaataggtagcaggcaggacacaaaaggagctagccaaggacttattgcagttgagacaggaaggagagactgcaacagcctgctaccatgaaaggtgtatgtgtgtgtgtgtgtctgcatgtgagttcattggccggggtagtaatggtgtttaggactacatttgttatctaggtaatgtaggggcaagggaaatgagatagccctgtttttgttttcagtgttttccttcaaggcctgtttttctctctgggttgagaactaggaccattttcctggttactgtttctactacttagggaagtgtagggagaacataccttcctgtgtgtgaattagagcaaaggccaagtctctatgtgtgcatgtgcctgcacatgccagtgttctgcatttgaaataggtctggtgggccattaaaagggacacgggcttgagcgtttttggtcttaaaggtaggggtgacttaagcagttatagcctttgtagaaagagtctatagaaccagacacatcgaaggtctaggagaagaaaaaatggttctcctgggagaacaacattcctgggagatagtttacctactaatgaagatatggctgatcaggcaataagaattgaaggaaacaacccttgatggtgaaattggaaaccacaaggaagagaaaatgattgaagtcatggggatggtgtacttgtcacggaaaagcatgttgaagatgggaagaaatagaaacaaacttagatgtggagacctgagtggaaggagcaagtagagcagaaactcacaaatgtaaggtcagttttacatttgtcactttagaaaatcagaattaaatttatgttttaggaattttaggataaaataaataggcattcttctatcttcttaagagtattgtgagcattatagtaattcagtttccaggtatatgcaccaaagaattgaaagcagggatttgaacagatatttgcacacccatgttcatagcagcattattcacaatagccaaaaggtggaagcaacccaagtgtccactgatagatgaatggataaacaaagtgtggtacatggcatataacccagtcttaaaagagaggaaattctgatacatgctaaaacgtggatgaaccctgaggacattatactgagtgaaataagcaagtcacagaatgataaatactgtatgattccatgtaatcataattatattccatgtaataaatactgtataattccatgcactctaagtaatcaaaattcatagagatagaaaatacaatggtggttgccaaggtccaggggaagggggaataggaaggtagtagtgtttaatagatacagagtctcaggaagattaaaaagttctagagatggaagatggtgatggctgcacagtaatatgaatgtacttaatgccactaaactgtatacttaaaaatcgttaagatggcaaattttttgttatgtgtattttaccacaatgaaaacaagtggagggctcaaaaatatatacatttcataaaattacagtaatctgacaaccacagttttcggaccactagagttcattaatagtgatttaaatttttatagcaattgaaaaaatctgagatctttcacaaacacaagatttagtttagtcctttatagttgttcctaaagttgtctattaaaattacttattaaactccataaacacacaaaatacaaatgtctgggccctgccccagacctattgaatcatactctccagggatagatgccaaacattcacatcttaacaggtgcttcagaggacccttatgcagcaaaaaaatacaagtgcccccccacacccaaattactcttccctctttagacctgggggtaggcctcttggggatcatgcagagaaaagatcttttaaattttatcctttcaacaaatgtatgagaggctagtctggggaaataatacttcttaatcaccttgataatttataaaaatgcataagcattttataaaagggaataagggaggaccagtaataaaagatgtaattattgccatctttggtgagtggaagtttagtgtcaggtatttgatttagaaaaataaagaaatgtgacagtcctaccacttcaagcattgtagaagtatatatatgtctgcgtgtgtgtgtgtgaaatatatattatatatattactattttttccattgcctttcattaaaaaaatttttattttactttaagttctgggatacatgtgcagaatgtgcaggtttattgcataggtatatgtgtgccatggtggtttgctgcacctgtcaacccgtcatctaggttttaagcctcacatgcatcaggtatttgtcctgatgctcttcctctccacctctcccatgacaggccccagtgtttgttgctcccctccctgtgtccatgtgttctcactgttcaactcccacttatgagtgagaacacgtggtgtttgggtttctgttcccgtgttagtttgctgaggatgatggcttccagctttacccatgtccctgcaaaggacatgatctcattcctttttatgactgcatagcattccatggtgtatatgtgccactttttctttatccagtctatcactgatgggtatttgggttggttccatgtctttgctattgtaaatagtgctgcaataaacatacgtgtgcatgtatctttatagtagaatgatttatattcctttgggtatatacccagtaatgggatggctgggtcaaatggtatttctggttctagatccttgaggaatcacactgacttccacaatggttgatctaattcacattcccaccaacagtgtaaaagcgttcctatttttccacagccttgccatcatctgttgtttcttgacattttaataattgccattctgactgatgtgagatggtatctcactgtggttttgatttgcatttctctaaccatcagtgatgttgacctttttttcatatgtttgttggctgcataaatgccttcttttgcgaagtgtctgttcatatcctttgcccactttttgatggggtttttttttttcttgtaaatttgtttaagttccttgtagattctggatattagacctttgtcagatgggtagattgcaaatattttctcccattctgtaggttgcctgctcactctgatgatagtttcttttgctctgcaggagctctttagtttaattagatctcatttgtcaattttagcttttgttggaattgcttttggctttgttgtgatgaaatctttacccatgtctatgtcctgaatagtattgcctaggttttcatctagggtttttatgattttggattttacatttaagtcttcaatccatcttgagttaatttttgtataatgtatgaggaaggggagtccagtttcagttttctgcatatggctagccagttttcccagcaccatttatgaaatagggaatgctttccccattgcttgtttttgtcaggtttgttgaagatcagttggctgtagatgtgtagtgctatttctgaggtctctgttctgtttcattggtctatatgtttgttttggtactagtaacatgctgttttggttactgtagccttgtagtatagtttgaagtcaggtagtgtgatgcctccagctttgttctttctgcttaggattgtcttgactatatgggctctgttttggttccatatgaaatttaaagtagttttttctaattctctgaacaatgtcaatgatagtttaacaagaatagcattgaatgtataaatcactttgggcagtatggccattttcatgatatttattcttcctatccatgaagatagattttttttccatttgtttgtgtcctctcttatttcgttgagcagtggtttgtagttctccttgaaaaggtccttcactccccttgttaggagtattcctaggaattttattctctttgtagcaattgttaacgggagttcattcatgatttggctctctccttgtctattgttggtgtatagaaatgcttgtcatttttgcacattgattttgtatcctgagactttgctgaagttgcttatcagcttaaggagttttggggctgaaatgatgaggttttctaaatatagaatcatatcatctgcaaacagagacaatttgatttcctgtcttcctatttgaatacactttatttctttctcttgcctgatttccctggccagaacttccaatactatgttgaatagcagtggtgagagagggtatccttgccttgtgccggttttcaaagggaatggttccagcttttgcccatttgatatgatattggctgtggtttgtcataaatagttcttattattttgagatatattccatcaatacctagtttattgagagtttttaacatgaagggatgttgaattttattgaaggccatttctgcgtctattgagataatcgtggagtttttgtcattagttctgtttatatgatggattaggtttattgattggtgtatttgaaccagccttgcatcccagggatgaagctgacttaatcgtggtggataagctttttgatgtgctgctggattcagtttttcattattttattgaggatttttacattgatgttcatcagggatattggcgtgaagtttctttttttgttgtgtctctgccaggttttggtatcaggatgatgccagcctcataaaatgggttagggatgagtcccttcttttcaattgttaatggtttcagtagaaatggtaccatctcctctttttacctttggtagaattcagctgtgaatctgtctgttcctgggcttttctggttggtaggctattaattactgcctcaatttcagaacttgttattggcctattaagggattcaacttcttcctggttcagtcttgggagggtgtatgtgtccaggaatttatccatttcttctagatttcctagtttatttgtgtagaggtgtttatagtattctctgatggtaatttgtatttatgtggggtcagtggtgatatcccctttatcattttttattgtgtctatttgattcttctctttcttcttctttgttagtctagctagtggtctatctattttgttaattttttcaaaaagccactcttggattcattggtttttttgaagggtttttgtttgtttgtttgtttctatctccttcagttctgctctgctcttagttatttcttgtcttctgccagcttttggatttgtttgctcttgcttctctaattctttcaattgtgatgttaggatgtcagtttgagatctttctagctttctgatatggtcatttagtgctataaatttctctcttaacccagctttagctgtgtcccagagattctggcacgttttctctttattcttattggtttcaaagaattttctgatttctgccttaatttcattatttacccacgagtcattcaggagcaggttgttcaatttccatgtagttgtgtcgttttgagtgaggttcttaacaggactgtttgagtgaggtcctctcacttttgtgatttcagtatttttgcatttgctggggagtgttttccttccaattacgcggtcaattttagaataagtgccatgtggcactgagaagaatgtatattctgttgatttggggtggagagttctgtagatatctctcaggtccacttgatgcagagctgagatcaagtcctgaatatccttgttagttttctgtcccgttgatttgtctaatattgacggtggggtgttaaagtctcccactcttattgtatgggagtctaagtctctttgtaggtctctgagaatttattttatggatctgggtgctcctgtattgggtgcatatgtatttaggatggttagctcttcctgttgcattgatcccttgaccgttatgtaatgcccttctttgtcttttttgatctttgttggtttaaagactgttttatcagagactagaattgcaacctctgcttttttttttgcttttcatttacttggtaaattttcctccatctgtttattttgagcctaggtatgtctttgcatgtgagatgggtttcttgaatacagcacactaatgggtcttgaactctttatccagtttaccagtctgagtctttcaaatgggccatttagcccatttatatttaaggttaatattgttatgtgtaaatttgatcctgttctcatgatgctagctcgttattctgcacactagttgctgtgatttcttcatagtgtcattgggctttatattttagtgtgtttttttgcaatggctggtacaagtttctcctttctgtgtttagtgcttctttcaggagctcttgcaaggcaggcctggtggtgacgaaatctctcagcatttgcttgtctgaaaagaattttatttctcctttgcttctgaaacttggtttggctggataggaaattctgagttgaaaattcttttatttaagaatgttgaatattggccctcaatctgttttggcttctagggtttctgctgagagatccgtgctagtgttatgggcttccctttgtaggtgacctggcctttctctctggctgcccttaacatattttccttcattttgactttggagaatctgatgactatgtgtcttggggttgatcttctcatggagtatcttagtggtattctgtttttcctgaaattgattgttggcctgtcttgctaggttgcagaagttctcctggataatattctgaagtgtgttttccaacttggttccattctccctgcctctttcaggtactacaatcaatcacaggttcagtctttttacatagtcccatgtttcttagagattttgtttattccttttcattcttttttctctaatcttgtctgtctgtcttatttcaacaaatggtcttcaatctctgatattctttcttccacttgattgatttggctattgatacttttgtatgtttcataaagttctcatgctgtgtttttcagctctatcaggtcatttatgttcctctctaaactggttattctagttagcagctcctgcaaccttttatcaaggttcttagcttctttctttggattaaaacatgctcctttacctcagtgaagtttgttgttagccaccttctgaagcctacttctgtcaattcatccatctcatcctccatgcagttctgcacccttgctggagaggtattgcaatcatttggaggagaagaggcgctctggcctttttaggttttcagtttttttttgttgttgattctttttttttttttttttttttaagacaaaatctctcactcagttgcccaggctagagtgcagtggcatgatcttggttcactgcaacctctgccttccaggttcaagtgattgtcctgcctctgcctcctgagtagctggaattacagacacatgctatcatgcccggctaattgttttgtatttttagtagagacggggttttgccatgttggccaggctggtctcggactcctgacctcaggtgatccacccacctcagcctaccaaagtgctgggattataggcgtgagccaccttgcctggcctcactgattctttctcatcttcatgagtttgtctagtttcagtctttgaggctgctgacccttggatgaggtttttgtgggaacattttttttggttgatgctgttgttttgctttctgtttgtttgtttttcttccaatagtcaggtccctcttctgtagggctgctgtggcttcctggggttcatttcaggccctattcatctggttcacttccatgcctggagatgtcacttgaggaggctggaggacagcaaagatgggtgcctgctccttcctctgggatctctgacctcaaagggcactgacctgattccagtaggaatgctcctgtacagggtgtctgacaacccttgttggagggtctcactcagttaggtggtatggaatgcaggacccaattaatgaagcactttggctgtcccttggtagggggctggtgtgctgccatgtgggggaaacccactcatctgggcttcctgtattcctcagaactagcaggaggaaacactaagtctgctggttcatggagactatggccacccctcctgctaggggcttaggcccagggagattacggttctgtccctgagcccctggctggagttgttggagttcctgcagtgaggccccacccagtgaggagggatgggtcagggtcagacctgaagaggcactctggctgtagtctgccacagccggtgtgttgggctgtgggggatacctcttgggaccaagccatccagcctccctggctccagcaggggaaaagcatgacctggagctatggagatggctgctgcccttcccttgccctgggggcttagtgtgttaggcagctagcagtcccagtgttggctgccatccctccctcaaggagctcaaatggcttagacagcgggaagccgcagctgtggtgctggccgccccttcccccaataactctgcaggcttaggcagattctagctgagtggctgttgaaaatctatgtggcttcatggttgggaccctagacctgggtggcatgggctcatgagtgggatcttccattgcacagttccatgggaaaagcatggtttcccaggctgagtagcatgcttgctcactgccttcttggctggtgggtgggggctcccctgacccttgtgggtctcaggtaggccgcagaaccacactggtcttcctttctcttggtgggtcatgccagccgcctagtcagtgctgatgacagaacctggatacctcggttgccagcacaggatttgcaggctgttttgtttctttttgatgcaagcctccaattgtggctgcttctagtcatccatcttgggcctgccccccagttgcctttccagacctgtgtagggcagagcctttgggtttatgtatagaaagaatgcaaatgcaaaacattaaatttcaagccagtagataatggttctcaatccttttaactggatgccccagcagatcacagaacagcaacatgagttctagaacaaatgcaaaaggtgctctggtagaggacttcctgccagaacaagttttcaatgacaaatatgacctgttttggataagacgtattctagacttttatttactctgcttttaagtattatatatatttagcccttaattttttgttcctgtcaaaccttttattttccacgaagaagtattgtcaaccaaccattctgccagccccagaacttttcacatgcaactttttctccccatggttggcaagggatcactgtaattatttcaggcatgaaaataagcatttatacacttacttttcattaccttaagaaaaactgaacaagtaactggaagcattttaataagtgtggcagggcaaggtattaataatttacaggagcaatatccctgtacacaatcccttcctcgccccattggagtagtcttatcagaaaaaagaaaaaataataagagctgattattcccatggaagattgtcctgagggcatttgtaaaggtaaaactttgaagctgcagtcttggcacctgtagttgagaagatgtctcactgaagggacctgggacagacccatctctgattctctatgggctgctatgttaccagttctcaaagatgggggaagagaattgtgctcaggctgagttctgcactcaaatgaggaacggtaagatggcaaccacaatggaataagaacctgccctcccccaccctttttctctggaccttgtcagccctaggatccttgtaaagtccctcccttgaagggagtggaagtaagtatgtaccaatgactgatattgatcagctgctttcctacctaggtgagcaagggctcagattgcagagtaatttgatatagaaaactaaattgaacaattctagcaccttgtgttatgcaggaacttattcatgttatatatgatgatggatattgcctaccattttttaataaaattgatttccacaagacctgtttttttggggggttgggtaggggggcttgatttttcctacaggaagatgagtctttccctggatcaagtgtgggagaaagaggggaagaccgtggaactggttctgagcaaaagtgtaagttacactattatggaaaagatctatgcacattttgaaactcgaaggttttccagaattattgagtttatacaaattctgtttttaaggctgaattagcagctatcagaatccattacaatttttttgttttctttttctttttctttttttctataatagaataggcttgctgttgaggaaatgtgtgaaaataccagtgggggagcagatttttctaactgattaaaatatgtggagctgctgcaatgatttcctctgtgtttcctttggctacagataataccacaaagctaactcagtgacgcacatggccagctgataacagctgacacatgtgaatcgaaagccaagtgtgtattatcagaaagtgagttaaaaacccataaaactccccactgtctgacttgaaaacattcctcttgaaattttaatgacatggtaggtaatatttttaattctgcgtgctaaaacacttccagtgaaatctgagagtaaaagcatgtccctttaatcaatatgagctagatatacaacctaagtattaatatattcctgcaatagcaggattcctgagaattgcgtaaaattggtatcattcattaggatgtacaactaaatattggacgatcttgatttgccttttaaaatttaattttaatattgtaatcaaacattgacaaagttaaaaaactccaacagtaccatagctttaaaaagaaaaccagcagtcctctgctaaaacccttcccatcacagattcctgttccctggagatactttcaattattgtagtcgttatgtttattgtttactgtaatattttaaaataatcttatactattatttcttcaattttaattcataaaaattatctaatgacttcatattactgaagatatgaattttggtctcttctactgcccacttctctgttcacactttccttttcctatccttccaatgcgacttttgatgaaatcagtttggtacatttttcttggttaaattccctgcttattatgattatttaaacataattcaccactgagccatagtgaattatgatcctatttctttcttatacagcttttcatttttcatactaattgctttttgtcaagtttagtcttctatgcagccatcattaatttattcccaaacttcccacaggacttcagatcttctctcatctctcaatatgttaaaatacacctaaaagttaaataaaaaaataagctaataggtactaggcttaatacctgtgtgacaaaataatctgcacaagaaacccctatgacacaagtttagctacataacaaatctgcacatgtacccctgaacttagaataaaagttaactaaaaaaaaaaagtccaccaaatgtgggccatgaagatgcgcagcccagatctccttacagagtctgctataggacacatggggattgccttcagttgctgctcctacagctgcttagaacatgcttcccctaggttgttctcggccaatgactgaacatggctggggtattagggcctagtcctgtcctagtaccaatgaacaacttttgtgtgggactcccctctccactggcctggctacaactttctcagaactgtgctgtggtctggggcttttctacccaatcctcccttccctctcctttcaaaaggtcatatctgcaaacagttatccctgcctaatcctggtctggccccctttatccttcacagacattccccccagtaaatttcttgcacatccaatctcatcttggcacctgcttctcaaaacggggccctgagaggagtctgagaaagcaggctctaagatggacatgtggattggcttactctttgccctgatggtggtaaggaggaccccatcctgagagtaatatgaggtcaatggaacctggtacagttggaggctcaattacttaaatctcacttgtggtgatttgggaaaacagccagagggctgatgattgctaagttatattgatgtcctacaaaggataatgaaaaactgagagtgattaacaaatagtgaaaggctaaatgtaagtgccagagggactgttggtagttcacaaataggtccttatcttccacagtagaagaacatacacagctgagaagcagacatgggattttatagttaaagtcacaaagcctcagaaacatttaaatgctcagctgaggcaggttctggaaccctgacacatgcgatagagacatctaggagaatgccttgagattttttttttttgagacggagtcttgctctgtcacccaggctgtagtgcagtggtgcgatctcggctcactgcaagctcctcctcctgggttcacgccattctcctgcctcagcctccctagtagctgggactacaggcacctgtcaccatgcttggctaattttttgtatttttagtagagatggggtttcaccatgttaaccaggatggtctcgatctcttgacctcatgatccgcctgcctcggcctcccaaagtgctgggattacaggcgtgagccaccgcgcctggccaagggtcttgacactacagatcccctgaaccctcagagcttacggagacatctcctttttccatagcaagggctactgcttcctctaattggaagatgctggagaggcctcttcccaatcaggcaagcgccgcctcaggaatgcctccattcctgagggtcaaatcccagtgcagcttcatggggaatgtgctgggcctggtaagaaaggaaagaaaccatgtactaaaggaacagcaggaactagttagcatgaactagcagaagccaggggagtatattagtgattggattttgaggaggtgatatggtttggctctgcgtccccatcaaaatctcatcttgtagctcctataatttccacatgttgttggggggatccggtgggagactattgaatcatgggggtgggtctttcccatgctgttctcatgatagtgaatgggtctcacaagatctgatggtttgaaaaacaggagtttctctgcacaagctctctttgcctgccaccatccatgtaagatgtgacttgcttcttcttgccttccaccatgattgtgaggcctttccagccacatggaactgtgagttcaagtaaacctctttcttttgtaaattgcccagtctcgggcatgtctatatcagtagcatgcaaatgaactaatacaaaaggcttgatcaaggggaccgagaaatgaaattgtataagcaaaatttattgacttgggggtactttcttgggacataggatcctggcaaggaccccaagtgatggaacaaacttgttgccagcatggacctttgaaacctggaaaaagcaatggtctgaatgaagtggaaatgccagacatcagaagaattacaaaggctaagggaatcaggcaaagagtgaagactttaaatcagatgttaatgcctaccagaaagcatacaccatggaagaggcactgaacaactaaattgacaaaataacttggtcatttggcattatccagtcttcatgattggtcactctggtactaatgggaaaggaataataacatagtggtcatcatggtggcagagatgaaagatatacatgggcccaacagtgggaactttcccacttaccaaggtcaatctacctactgctgcctctgaacatccagtttgtcattaaccaagatcaacactgagccctgatatggcattattgctctaggggaccaaataaccacttggtggcaaaccaaccaaattgggtctcttatctggtggatggaccagcagttcgtccactctgggacagatacctattctgggtatgatttcctgcccactgagattcagctaacactgttttctgggggcttaaagaatacttgactcataggcatggaatcctgtacagcatagcatcagacaggggactcacttcacagtgatgtaggtgtgggagtagggctatgacatgggattcactgatcctatcacctactgcatcatttagaagcagctgctccatagagggttgggatgactttctaaaggcacagtgagagtcctagttaggaggcaatactctgtgaggatggtgtatcattattcaggatgtagcatatgcattagactggagaacttcatattgtattgtgaccccaggaggacgaatacatggatctgggtaccaaggaggtggaaccagaaatagctccatcccagtgatctgctgggggcctttgtactttccatcttgcaactttgggctctgcatgattgaaagtctgtactagtttgggttctctagagaaacagaaccaataggatacacacacacacacacacacacacacacacacacacacacacacaccccttccattcctgagggccaaatcccagtacagcttcatggggaatgtgctgggcctggtaagatgtgtgtgtgtatgtgtatttttatatataatatatgtcctatatatttagaagtacatatatacttcttatatatttatatatactatttatttacttatatatataatcttatgttctatctatttagaagtatgtatatgtcctatatatttagaagtatatatttttatatacaatatatagtcctatatatttacactttatatatacacattatattaaatatatatacattatatggtaccttcatattaaatacataaagtatatgatatacttcctaatatataggacatatattaagaatatatgtttttatatctctctatatatttatatgtatagagacatatcctatatgtatattcttagtatatatgtactatataaaggacatatacaaatatatatggtttttttaataagttttttttattttttagttgtattttaacatattgagagatgagagaagatctgaagtcctgtgggaagtttgggaataaattaatgatggctgcatagaagactaaacctgacaaacaacaattagtatgaaaaatgaaaatatacaaatgtatatgtccttaatctatataggacatatatattaagaatatatctctgtatatctcttatctttctatctatggagggattgatttattataagaaattggcttacaaaattatggaagctgagaagtcccatgacctgtagtcagtaagctgaagacccaggtgatctggtattaacggtatagtttcagtccaagtctgaaggcctgagaaccaggagagctggtggtgcaagttccagtctgaatgccagcaaatactgatgttgcagtctaaaaataggcagagggagtgaattctccctcacactgccttgtattctacttaggccaccaacagattgggtgaggcccacccacactggggagggcaatctgctttactcagtctgctggttcaaatgttaacctcatccagaaagaccctcgcagacacacccagaataatgtttaaccatatatctgggcaccctgtggaccagtcaggctgatacataaaattaaccatcacaaagtctatgtccccaaagggagtcattcttgcaaagagacacagtaaaggtctccttgaattataagctacagctactgccagaccacttttaatttcctgtgtccaaggaccagaaattggggacaggaggcaccatcttggcaggggcagttggcaagagaaggtaagactgctttcccacaatgggagcaggaaggaattcatgtggaaccaggtggtcctctgggtaccgcgctgcccagtgtaactgtgagtgggcacatgcagcaatcctaacctgaaaagtctctgattagaaagagctcaggctcctcaagagcaaagttttgggtgaaaccaccaggtcagcctgaagactttctgaggtgacagctgaagattagtggaattctgagtaaataacgatgaaaggagaggacgagtgcccatggcatccctaaaaccacctgcagtgacgcaaccatcatgcatcccaccagctttcctcttctcagattcctttcaagaagagaggcccatgacactttggaggaactgctcctcaaatgtgcctgaaatgaatctttttttttttcccttggcttcagcatcccaagtagctgggattacaggcgtccaccaccatgcctggctaatttttgtatttttagtagagacggggtttcaccatgttggctaggctggtctcgagctcctgacctcaggtgatccacccgcctcggcctcccagagtgccgggattacagacatgagccaccgagtgcagctgagaagcgaatctttcaagaagtgtggctataatgacaacaagagagaagggagaaaccatgtcaagaaacagtttatttaatatgagggagtgtattttaaagaacgcaaagtgggagcgacttattgaagatataagagagagggaagagataagtgattgacaataaattgtccctgagaagataggaagaaataggaccttggcagaggagtggtcaggagaaaagagaaagatgctctactgtgatcagagaaaagagtcaaaggagaggtatgagcctacatttatagttttggatgcagatggtgagggcattcctatgtgatgggttctttttctatttgaagtttgaggcaactttgcttagactgaatggcacttggtagcatgagagtggtgtgaaaagagaggtgaggtgattgtgggaatagtaggtgcaattgagatatttgttcaaaaacaagtggatctttaaaatcattttttgagcactaacaatgtcaggcacactactgagctcttttccgcattatttctaatatttaaacctatcatacttactctgagaattaatgaatattgcctttaatttattggaaaagaatgttttcttacttgtccaattcattcctttacttgtttaacatatatttactgagcttcaattatatggcaagcactgttctcagcatagtaagtaagtgtatcagtaatgcaaaccaagggctgcctgatttcaaaatccagtttccttatagtatgtcaataaaaatgatccaacaatacaaaatattgactctgtgagccctctaccgggttcacctattctaatgagacagggaactactactttatacaacaaagacagattgattatttatagttgtttaaattatttcaagtatattttcaatgataagtttggaagttgaattccaatataatttctttatggtaattaagaagatgaattagtatcttattaaaatgtattttccttacatattcaaaagcaacatcttgaatatttgaaaacgcttatggtaaaattatgactaattcatgatttagtgcatcgcacttcagctgaaatttacattggcatttactttgaagaaataatttgataaccaatgtaataatttgcacaacatttaaaaaaggtttgtgagtttgaggagtggttgtggttgcatttaactcatcctttaaaaccagctttttttaattggtcagcatatttctttgttagtaactccagtcatttattgaagcacactcaaatgatatttacttgcacaaacatattagggttataatataccttttctgtttttaaatttctatttgttgcaattgtagacagataaacgttattggccccctgtgcacatggggcttttgtgggaaaagtgcaatgctataatacattaaaagccataagcttttacattaaaaagcagtgatgatgggatgagggtaagtgccatcccatggtgttattgctatagcatcagctgtggcactattttcatgaacagacttagagttgagtacctctcaaagcaatttttatgtttgaacaaatacagtgatggatcagcagagtgagttactcatcaagaacttggcaagaaggatgagttacgctgagcaaaaatgctgctgagtttaatgactctttgggaacatgtaggcacttaagtctctggggtctaaatctggttaattcacaagtgtgaaattgtcagcctacttaaaagaggcagaaattatgcaatgcttttagaaagcaattttaatgtaagaggagcactggaagccagacagggcatagtagtattatattaatgacttttgttttgtcatggtagaacagttaattgattccatgaggaagatggaacaaaagagactttctagaaatttcattctccttctaggagagaagagataatcagggaaggatttctcattttaaatctctgaattagttcttattcctgattcaggaaaggttttctctaataagtatgcactcagagtttgaagaaaaatgtgatgtgactaaagagaaaaaacaataatatgaaatgtctttattaccttaaataagtaaaattagattcaacatacccatttgttagatactgggatttttgaagggatgatttaccatgtataacatgttctcatttctcaatgtatttcacttccttggccttcaaatattgcacttgttactattcttacactttaccagtgaaattaaatcaaggcaaataagagtttttttaacatgtttttaaaactttttagagataaatgtgttccttccactcctatcgaaaatggagtaacaaggactttctaccagaagcaactagaaaaccaagatatatacgtctggtttttaaaccttgagcctaagatatcataggcctgtgattgcttcaagaaaaaaaaaaaagaaagtgcgctctaaaattgcatttttttttttttgcatagcaggtagtacagggaggatgcattcagagaccagagattctgctaaattgaagaaaaagaggaactaacccacaaaggccaaatttgttagaatttgcaagcagtctaccagtggggaaggaacagcacaaagacagagctctagaaatctgcagagaggttcccacaagtctttggatgaatactgatctctataatgcatgagaagaaactatctgagattggagtgggtggaacaccacaaatagagtgaggagaacagtttcagagctcaaactggctagaaatagttcatgttttcaccattaaagtggaaataatttgtcatacaaagagtattgggtagaatgctcagaaaactgtcacctttgttgtggggataaactggctctatgctaaaggctgctctcaacacacacaaagcttaaggacaagcatcagaatgatttaactggttccaagcaacttaactgcatgccaaagcaaagtctaatgctattttaaggaatacaacaaaactcagtaaagaacaacgtaaaaatcacaatgaatggcatccaacagaaaactaccaggcatacaaaaaaaaaaaagaatatgattctagtaagataaaaaacagaaacaaaatctacaaaatagacccagaaatgaaaaaaataataaaaccagcagataaggatgttaaaatagtgattataaatatgctcgatatgtttaataaggtaggtaacaaggagataaataacctaaatggaatttctaaagctgaaaaacacagtatctgaaagggaaaatgcaattgaatggggtcaacagctgattaaacaatgtagaagaaaagatcagtgaactttaggatgtagaaactatccaaaatgaagcctaaagaaaaaaaaatggttaagacaaatggacgtaacatcagtgacctgtgggacaatatcaaacagtctaacatgttattacatctaattggagataaagaggtgggagacataaaaatattcaacaaaaaatggccaaatatgattccaatttgattataaacagaaattttgagaagaagccagagggggaaaaaatcttatcatatacggaagaacaaagaattgtcacagatttcttgtcaggaactgtgcaaactaaaagacaaatttaaagttctgaaagaaaaaaacttgaattttgtactgttgaatatatgtttcaaacaaatgcaaaaggaagactttttacacacacacacacatacacacacacacacgctctcttgagaaaatttgtcaaaagtacacctgtacaagaaatgttaaaggaagttctttagggcagaaaattcataactgtttttttttttattcattatgcctttttataaatgttgacatttttctttattgtaatgtatttttaccatgaaatttactttacctgaaatcaatattgctatttttatttattttacctgatttttgtcttaattagctactgttttttcttcatttgtaatatttataatatatttatttaacataccttttctaaggtggaatagtttgaatgctactttttgaattattctgtgtttgtctctttttgaattgaatttaagcaacttgaatttagttataacaaatatatttagtctgtctcctgtcattttgttttatattgtctaaggcttcattttctatgccaatactttcgtattctaaattttagggactattagtttatgtatgggtatgtgtgttgctgttgcttatatggagcatattttgtttgcttttataaattgcctactgcattagaaggcatctgtaaggcttaggtccaattctattagtgatcactttcacattcaaaactatgcttgaatctttttttaaatttccctatttctgaatttcaagaatgaaaaaaaattgctacctgtaatattacatgaataatttgatgtatttcaccattcttctagaaaatatactcatttttgctatttcattatgttattaactttttaggagactatcaaattgtttgcaacgtgatgatgtcatttcatagtcccaccaactatataggaaagatgtacttgctattgtagccttaaaaatttttagcctttagaagttttatagttttagtatttatattacggtctgtaatccatcattttgagttaattttttaaaaggtgcaaggtaaagattaaacttcatttttaccgtatggatatccagttggtctagatcacttgtggaaaagactatttttaaccctgttgaattatcttgacactttgattatcttgaaaatcaattgacaatatatgtgtgggtctattctgaattctcagtttggttccatggatctatgtatgtattcttatgttgataccatattctcctgattactgtatctttatagtaagtcttgagattaacaagtataaatcttccacttttccctcagctatgctgaatcttttgcatttctacataagttttagaatcagcttgaaaatttatgtcaaaaaagcctgtgagaatattgattaggattgcattgaatctacagaccaatttggatataattgaccttttgacaatttcagttttctaattcataaacatgtatgccttatctttttgtgtatatcatttaatttttctcaaggatatttgtataggtgttgcacaaaatttgttaaatttcttccctgtctcaaagtagaaaatagaaaacaatcacagagatgccattataaaatatatagatatagcaatcctctaaaattcccatttaactctgtagtttgaccggaatgaaagacggctatcttggagaatgatgttagattaatcaagtagtcactctaataatagcaactgttccaactaccatctccatattgaaatcctacaaatgtttcctctttaaaaaaaaaattcaaaacagaagaaccagcagcatgtctttcactaactgattcagttagctcctggggcagtgatcatctccctattttataggacatcatactcatccgttacattgaagataccatatagattcttggatagaataagaaagagagtgctaggtgccttagagtacatgtactgatgaaaatacaggagcctgacacttaattaaattttttggaatttaggagccttggtcaagaaagatagatatctttattagagtaactaatttttttttaaagagatgaagtctcactttatcaccaaggctgaagtgtagtgggcacaatcatagctcactgcagcctagaactcctgggctcaagtgattctgccacctcagcctcctgagtagctcggactacagacacatgccaccatgctcagctaattaaaattttttattttttgttttttatttatttttatttttatttatttttattttttatttttttttagagattggatttcaactatgttgctcaggctggtctcaaacttctggccccaatagatcctcccacttaggcctcccaaagtgttgggattacaggtgtgagctaccatgctctacagcaatgatttgctgaaccttgtccatccttcaatgtttagggtatcttttagattttgtaggcaacttatcccatgtataggtgtgtgctgcctaatttattaactgaatgacctaaaaagcttccccattaaggcccagaacaagggagggctttcctgatggcccaggctgcagtgtaaacagctaaactgtttggctcccatgttgcttaaagtgtctatggaagatacgaatgctgtggcaagtcctataagaggattgcagaagagactggtatctttgatttgagatgcagctggaatggaaatttgtctcacttcactttctgcctcatgtttcctccatcaccaaggaagctggtaataacttggttggtctgaacccatgcacagctcagaagtgtgagtgagttaatacccccaaggaaaacttttgactaattgggggaagaaagcagatagataaatgcttctcctgtttccctccttctgatagaaaattcagggaggtatctggaaacttctcaggagccctcaacagaacagtgcattaatatactacagccaaataccactaagaacacatctgtggcagaacaagttcggctcaaggttcattgcaacaagggagaactcccctcatagggatctttgggacatttctgtaagatggtgttaaaaggacgtataggatttttagctatgccaggtattttgaggagagttcaagaatgcagggctttgttatggattagatgctgtcaggaagtgaggataattctgactgggtgtcttaaatctttacaaggtgagaagactaaagtgagggtaaatctaattgataaagaatcatattagcaaggttagggagacgcttggtcatttgtatggtttggataatgttgtttttaatctgtgttcagatgtgattacgaagtggtatttttgctctaattcattacagttgtggtgtggccttgttgatgttgatgttctaggaaaattgttcacatccaacaggagaatgttgagacctagctgtgaatgccaggccagctcttagcaaaaccaaagtctagctggtagttccaggctattcttatcagttaagagctatttttctctctctcaagaaccactggttttctggaaggaatagcttcaagaataccctcttataatggcttttcatccttcctgttgcattctttctggcctctcactctgtctcagtctataccttcagccttctgtaggcatggtaactcaagttgagatactctttcaggaacacaaacaatattctaaatagtattccccttttgaaaaacagctgcccatcatgaactgtgctatatgatccatctggccataaggtcgggacgtgctaactatgctccatcattaagtggacgtagatattctcaacagggctcaattgttcctgaaggcaaaagtacctttcctgaataggacattcacatgtccagtgtgccttcactttattacccttcagtttgctcctgtggcctgtggacattcccaatgactagttggctgaggaggtatggctgtgagtctgctttacagatggctctgcatcatatggcatcatctgctataactggccaaaataattatgaaaaagttcagctccattcaggattggtttagaaaggacattcctgaggaggcagaatttgaaacagaaaaactcattttcccaattgtatcttgagctaaggatataaggatgggacaaggatggggaaaagttcagagctacttccttggcagcagttttctgtggcagccatgtcagaggacagtatcatgttgacatcagcagtggcatcaatcagtctcatcctgggttatggtgatggaggaccaggtacctacatgctccacatctttcccgatgccttggacttacctaaacctctgagatgaagctaaaatcctggaaaaaaaggaagtatgtaggaaaaccttgatttcactgaggaaaaaattagaataaaccacattcaccatatattgactaatattatgtttttaccaccagagaggcttgagacaaaaaataagttcagtgatcaagaaaacaaagaaaatatccactctcaaatttgtagcctgataattcagacctgtagttagaagtattgacagtggctttctagatagagacactaagagagagactaggaaacttaggttacttaagttttcttatttgtactatttttcatacatgtaacaaaattttttacaacaaatatgtattacctctataatcagaaaactataagcattgctttagaggaatatcatcaaggcaaaaacactactgaaagtcaatgatgagtatctgtgactagtattactatggttattattattacatttaacctaatagaaatggtactatacatttactattataaaccttatcctaataggagttatagttgattaaaacacttaaatttatcttgttgatattttcttagctaataatattatactataaaattaatacttctcggtcttttttgcaaactcttaaaatatgaaagacaaaattcttacctcttggtcatgtgagtcatcaatgactgtggaagctactcatgagctcatgcttatttataatcttgaatatgtgctcacacagattatataacattaagcaagaagcaattcactggcaatgcctaatattggggcagatagacacttatatgagttacacagaaaatattattactcacttttgtggacagtgggggcagagaggatttgttttcagctctaacttcagtcaggaaatgtctctactgttaacaagaaaagctctagacttactaaagttaacagcatttatttgagcaaagattgattcatgtattggtcagcactcagaaccagaagacgttcagagagctctgctctacaatgtgggcagtgagtattcatagacagaagaccatggaagcacagaaataccttaattggttacagctaggcttttgccttgtttggacatggtatgaataactggctgcttgtcatttgctgaagctctgctgcttgtgattggttgagatccggctattttaactcctaaattagattgccctacaggttgcagttctttaggtaggaacttcaagtatacagacagcctcaggctaatggccttctgcttatttaatgtagcagtaccaaaagaagtttcattctaccatatcccctttccattactgcagtgtatggaaagccacatttatcccacagagagaatagggctggaacagagggatctgaccacagtgagagggcagatcgcagagactgaataggagtacggtgctgagtgtgtagacaggattcagaaccttccacagcaatcagctgatacagactcaccgcctaatgattcagaaaatgagggatcaaagactagaatggagagagaaaaaatgaagtgtggcaagagcaacaaggggtagtgggatgcacagaaaggatccaaaggacatcagcactaatccctcagttgacaataatggctatctggaagccacctacccctgagaaattgtgaagtacatgtgtagatctcatgacacaaaagaatacttttagtatattgctgctataatcaatatgattaaaaggttaactacaaatttggagcatattggtcacaaaacagctgacatttctttctggatatgtaccaggtaatgctgagcagtttatatgccttgggtacatttaatttttccaacaacactatgaggtaggtactgttttcctcattgagaaaagtgcagaatgaccaagtggcttgcttaaggtccacagcaaatggttggcagggccagattcaggctgagatatctgacttcagagtctgagatgttaattactgcatagacttcttttccaaactgacggatctctgtgaggagcatcatcacatctctgttaggagcaactgttaatttattaaaacctactgtaggctgggtgcagtggctcacacctgtaatcccaacactttgggaggtcaagttgggtggatgatgaggtcaggagtttgagaccagcctggccaacatggcgaaaccccatctctactaaaaatacaaaaaattagctgggcgtggtggtgtgcacctgtaatcccagctacttgggaggctgaggcaggagaatagtttgaacctagggggtggaggttgcagtgagccgagtttgcaccactgcactccagcctgggtgacagagcgtgacactgtctcaaaaaaaaaaaaaaaaaaaacaccaaaaaaaccaccactgtatattccttagagtttagatagtatgactgagtggagaaaattttaagagtgtggattcagcatcttcaacagaatttttggttctgttttcttaatttatcctatagagtagtttcaggtactgatatttgtggatacttggaccaaatggaccatatcaaatattatgccagagattctgatccctaaactaagtagaataggcacttgatttataattgtgtcttaacaacatcgtttctctcttatcttgtgttactctttgtcatttattcctcacaggaagaaagaagtacctaaggccccaccattagaacctgactctgtgtttctaatgcttcaggccaaggaggaaaacactgtatttaatgcgcttgcagtatttctattcttgcaaaatacttactgttccaagcaagtgagttttcaaataaaataagaaaagcattttcctatttttgctgcttaccttattgctctataaccctctacaagtgtatctatttccaaatcgttttctctggggaggctacatttcacacttctacaacataaaatactaccacagagattcttaacagttgacatttgtagacctccttgattgaaaggttgtgcagtgaatacatttgttttggaatcaaataaatattatttaaatttggaaatagatacacttgtagagggttatagagcaataaggtaagcaccaaaaatacgagaatgcttttcttattctatctgaaaacccacttgcttggaacagtaagtattttgcaagaaaaaaattacctcaagcattttaagtacagtgttttcctccttggcctgaagcatcagaaccatagagtcagattctaatggtggggccttaggtacttctttctcaccgtgaggaataaatgacaaggagcaacacaagataaataaacctgttctaatctagagctaatatgatataatttacaaatgttctggttttaattttaaacaaattattctgcctgaccccatgtttttcattgcacactaatattgatatttgacacatcagattattagatattcataacatttgattcctttggctatcatggatcattcttttattcagtaaatatttatcgaaagccttaaatgagccaaactctattctgattctgggaatatagttggtaacaagacaaaaaagatcactgttcttgtggagtgaatattctcatgaggaaagagagacagtattcaaaatgtaagaggaatatgttagatagtgatgagtgctctgatgacaataaggcagagtctgatgatagggagggacttgggggctcctttggagtgagtaatccaagaagactggaatggcaagcagggaccactgctgtaaaatcagtgaaagagcatcccagatacagggaactgacagagctgcagtcaacaacctagaaccaggctgttcaaggcagagaatgcacgaatcacagattgctttatctagacaaaataatcaaaagatatcctggcattcccccttctgttggtgaggctccaagaccaacctcacaagacaaatggtaagactggtttgtttggtaagactggttttattaactactcataaagatggcagaagcaacagaattgactttcttgcatagtaaacaggagactagtctgtgagtgacctggagaagcttagtacggctgtggccagtttgatagttaataggttaattctgataattatcagctgagttgatagttaatcctatattgaaatcctggaggagaaagaatacaaaagagatgacatggaaaccagcttcttgttcgcacttgttactgagaaaacacactgcataacacacaggttaaacgctgtttgctgttcatggggctttaattggagggtcactcttctggatgtttgtatcacaagtgcattccagtggcactggcccaagctgttatttccaccttgtagctcatgtggttttgctatggtgctgatgtgcgtaaatgtggttgtttctgtggttttcttacaggtcctggagaattacatatcatgcaaaaggttataggtcagcttatctttgcagatatagaactaggtaaaactcccctaaaataccggtgcttagcaaagtaaccttgcaagtttactttgcccttcaatgatcaacaacaaaaaccaaccaactaaacaaacaaaaattagaactcattagcttaacgatccatcattcattaatactcttgagcttatggagaaaacaaccaatatataaaatattcttcaattgtacctgctgcttttatttcttttagaagtatttttttaagctgtacttttcctaaagcctgagaatattttgtgttatttttgatgccagaaaggataatataatacactgtatgtctttaattcgttgtaactggtggaaaaagagaaagataattgaaaccttaaaacagcagagataagtgatctaagttgtaaatctgttagtaattcaagaacatttagaaatatctcctgataaggttaattgaaggaatattctaatgaatgtagtaaattagttgttcccaatctcaaaatcttttaatattctgaaagaaattaagattttagtgagagatattccactttatggaactacttctttctccctttatctctttatggaaaattctatcttaaggagcaaggtgaatctttcttgttctcttttactgcaaaatatttgtttttaatatgtaactaacctgcacattgtgcacatgtaccctaaagcttaaagtataataatagtaaaataaaaaaaaattgtttttaaagcaaaacaaacttacatagaatcaataatttctgttattaaattatagaatgggaagatgtattgcttattgtgatgaccctcaaccctggctgcacattagaatctcctggaatggggcttccaaaccttagtgtgcttgtgaatcatctagggagtttgttaaaatgcagattttgatttaggacttctggggtaggacctgagagtctgcgtttataacaaactcacaagtgatgttgatgcttgattagcctgttctttcattgctataaagaaatacctgagactgggtaatttatgaagaaaagaggtttaattggctcccagttatgcgggctttgcaggaagaatgatgctggcatttgctcagcttctagggaggcctcaggaagcttccaatcatggcagaaggtgaagggggagcaggcacatcacatggcaaaagcaggagcaagtgagagagagtgggccaggggaggtgccacacactctaaaataaccagattccatgataactcactattacaaagacagcaccgaaccatgagggatctgcccccatgatcgaaacaccttctaccacgccccacctccagcactggggattacaatttaacatgagatttggttgggcacaaatatctgaactatatcctgccctgcacctcccaaatctcatgtgattcttacattgcaaaatacaatcatgccttcccaacagtcccttaaagtcttaactcattccaacattaactcattccaagtccttaactcattccaacattaactcaaagtccaaagtcttgccttgagacaaggcaaatcccttccacctatgagcttgtaaaataaaaaaaaagttagttacttccaagatacaatgggagtataggcattgggcaagtattcccattccaaaagggagaaatcggccaaaagaaaggggctacaggtcccatgaaagtttgaaacccagcagggcagttgttaaatcttaaagctctaaaataatctcctttgacttcattttccacatccagggcacactggtgcaagtggagggctcccaaggccttgggccgctccacccctgtggctttgcaggtttcagctcccagggttgttctcacaggttgttaaatacttgcagcttttctagacagagggtgcaagctgctagtagagctaccattcttgggtctggagggtggtggcctacttctcacagatccactaggcagtgccctagtggggactttgtttgaaggctccagcccacatttcccctttggcactgccccagtagaggtttactctgagtgttttgcccctggagcaagcttctgcctggaagctttctcaggcatcccctgaaatctagacagaggcccccaagcgttcatcacactctcacattctgtacatctacaggcttaacaccacatgggagccaccccaaggcttatatactccaaagtggcagctggagctatacctgggcctctttgagccacagctggagctgagctggagcagccaggatataaggagcagagtccctgggcctggcccacataaccgttcttcccttctaggtctctgggcctgtgatgagaggggttgctgtgaaggtctctgaaatgcctttgaggcttttttcttgttgtatttgttatcagcacctggctcccttttaattatgcaaatttttaattttgcatcaaattaaaccagcaagtggttgctccatagcctgcttgaattctccctaaaaagctttttctttctctgccacatggccaggctgtaaatttttcaaactttcatgctctgatttccttttaaatattaggttgatgccaaacaatcacagtttgcaaaaacaattacttttaattgcaaaaactgcaattgcttttgcaccaacctaatataaattccaactttaggtcatttttttgcacccacatcagagtgtaggctgttagaagccaccaggccacatcttgaacactttgctgcttagaaattttctcttccagataccttaaaccatcactttttagttcaaacttccacagatccctagagtataaacagaatgcagcgaagctctttgctagggcataacatacatgagctttgctacagttcccaattaagttcctcttttccatctgagaccttgacagcctggccttcactgtccatatctctgtaagcattttggtcacaaccatttaaccaatctctcagaaattccaaactttcccttatctacctgtcttcttctgagccctgcaaacacttccaacctctgcctgttactcagttccaaagttgcttccacattttcaggtatctttatagtaatactccactcctggtaacaattttccttattaggccattcttgccctgctataaagaaatacctgagactgggtaattaatttatttatttattttaaaaagaggtttaattagctcatagttctgcaggctttagaagaaacatggcactggcatctgcttagcttctagggaggcctcaggaagctcacagtcatggtggaagacgaaaggggagcagccaggtcacatggtgaaagcaggggcaagtgacagagagaataggtaggaaggtgccacacactttgaaatgagcagatctcagaagaacttacactgactatcatgaagagatcaccaagccataaaggatccactcccatgattcaaacatctcccaccagtttccatctccagcactgtagattataattcaacatgagatttgggcagggacaaatattcaaactatatcatgtaggctttacaggaagcatgatgctggcatctgctttctaaggaggccttgggaagttttcagtcatggcagaaggtgaaagagggagcagatgcatcacatggcaaaatctggagcaagcaatagagaatggtgggggagggggacgacacacacttttaaatgaccagatcttgtgagaaagcactatcataaagacagcaccaagcaatgagggatcttcccgcatgatccaaacacctcccgccagactctacctccaacatagaggattacaatttaacatgagatttgagcagggacaaatatccagactatatcaatgctgttggtctgtggaccataatttgaatagcaaggagagagagcttttagaaattaccaatacaaaggccaagacacccatatatttggattcatggtatctaacacggggtccagaaatctgcatgttaacagaaacaacatgtgattgtaatgcatataatccacagatgggagtttggtctggctagaaggcagtactagccctgattgtgtacaggattagaatcccatgcaaatcattaaggctgtaattcctgtgcctctgtagtcttaatatttttatagcagatgctgatgtaaaaaaccactattctgggcattcaggaaagaacactatcattgtatgaacttagtgaaatgatgtgggaattttgagtgtatgcacaatcataaggttgtggttcatagctattaattgaatctttcttaaaatgtttttttgtataaatatatgggatacaagtgtaattttgttacatggatagattgtataccggcttgtatactggtgatgtcagggcttttaggatatccatcacctgaataatgtacattgcatccactaagtaatttcccatcatccacccaccctcccatctccccacccttcatgtctccattgtctatcattccacactctatgtccatgtgtacacattgtttagctcctacttataagtgagaacatgctctcttgctaccaattaattttttctttaagaattttcagattttactttagatatatgtgcaggtttattatacaggaatatagcatgaggctaaggtttggagtatggatcctgtggctcagatagtgagcattttacccaatgggtagcttttcaacccccattcctcttcctcccttcccacctctagtagtctacactttcgattgtttccaaatttatgtccatgtgtgctcaatgtttagctcccacttataagcgagaatacatggtatttggttttctgtgtctgtatttgtttgcttaggattatgacctgcagctgcattcatgttgccgcaaaggacatgatttcatcctttttatggctgtgtagtattacatcttgtatatgtaccacattttctttatccaatctaccactgatgggcacctgagttgattccatgtctttgctattgtgaatagcacagcaattaacacatgactgcatgtgtctttttggtagaatgatatatttttccttgggtatatacctaataattggattgctggattgaatggtagctctgttttaagttctttgagaaatctccagactactttcctcagtgactggactaatttgcattcctaccaagagcatatgagcgttcccttttctctgcagcctcaccagcatatgttgttttttgactttttaataagagccattctaactgggtgagatggtatcttattgtggttttgatttgcatttctctgatgatttgtagtgctgagcatttttccatgtatttgttggctacttgaatgtcttcctttaagaagtgtttgttcatatcctttgccattttttaatggggtttttttttgcttgttgatttaagttccctatagattctgttaataggcctttgtcagatgcatagtttgtgaatattttctcccattctgtaagttgtatgtttactctgttaatagtttcttttgctttgcagaagctctttagaaataagaaatgttgccaattaaataatgagatactaattatgagaagacttaatctaattttaaagatgttaaaaattttttaaatatgccctggagtcaatgaagtatattattcaattatggaaattctctgtacatagaacagttcaggaacacaaagttatctaaagagagtttggatttttacatagctcacctattttttattataatgtttctcatatggacaatgtatagtcaaggtgaaaacacagttctaattctgttcagggaaaaaaatagtagaaattagtttcctccattctgttctatattactatttaaatttagtttgttaaaggcttaaagtttaacttcacaaacatacaaaatcatagttttttgttaaataacaacatttgaattgtataaatatattattgtatttcttaatttataaactatattagcaactagaaagaaaaaaaaatgacttagaagatattttacacatttacttacattctttatgcaacctgaaccctcatctctttttaacattagggatgacagtgggtggacagtgggtggatctgaatttttaaagttattctctagcaactagaggaaaaatcttaccagattatataggctagaactcttgattgagaagacagagtattattaaggttctgaaagaagagcttttcattattcaccagcaggttttactatctaaaatagaattacatgaatttgtaaaatttgtcaccaaaagcttcatctacttgtaaataaaaaaatcctctcaatttttggccaggtgcagtggcttacacctgtaatcccagcactttgggaagctgaggtagatggagctcttgagcccaggagttctaaaccagcttgggcaacatggcaaaatcccgtctctacaataactgcacccttaaaaaaatagctggtggtgtatgcctatagtcccagctacttgggagactgaggtgggaagatcacttgggctctggagttcaaggcgatactgagctgtgattatgccactgcactccagcctgggcaacagagcaagacctgtctcaaaaaataaataaataaatatataaatatataaaataaaaaaataaaacttctgtcaattttggataggtataaacatcatgaaaaatagtttgaaaatttataactgagaagttgctgaaaatccttgatcggatctctgcttgcaatttctgcataaaagattttgagaatatatgcaatgcaaaataaagcattccatattttaaaagaaaaatattttcttgtcttaactatgtatactttttttatttgagagaagttgctcaaatataatatagttgttgactcaagagaatcaataaaaaaaatctactgaataaataacacagtttataaaatggttagttatgacatcattgccttcctcatacaaagaatgacctgttagaaattctaataaaaaagaatcctcttgtagtagcaacaaaaattataaaatgcctaagaacaaattttaatagagatatagaggccctatacagttaaaaattccaaaatgttaataatgagattataatacttgaataattttttaaaatacgtttaatttttccataggttattggggtacaggtggtatttagttacatgagtaagttcttcagtggtgatttgtgagattttggtccacccatcactcgagcagtatacactgcaccctattgatagtcttttatcccttctcccctcctacctttcccctcaagtccccaaagtccattgtatcattcttatgcctttgcgtcctcatagcttagctcctatatagcagtgagaacatacgatgtttggttttttattcctgagttacttcactaaaataatagtcgtcaatctcatccaggttgctgcaaatgccgttaattcattccttttgatggatgagtagtattccatcgtataaatatatataccacagtttctttatccactcgttgattgatgggaatttaggttggttccatgattttgcaattgcgaattgtgctgctataaacatgtgtgtgcaagtatctttttcatataatgacttcttttcctctgggtagatacccagtagaggaactgctggatcaaatggtagttctacttttagctctttaaggaatctccacactgttttctatagcagttgtactggtttacattcccaccagcagtgtagaagtgttccttgatcaccacatccatgccaacatctattgttttttgattttttgattatggccattcttgccggagtaaggtggtatcacattgtagttttgatttgcatttccctgatcattagtgatgttgggcattttgtcatatgtttgttgtccatttgcatatcttcttttgagaattgtctattcattccttagcccactttttgatgggattgtttgtttctttttttgctgatttgtttgaattcattgtgattctggatattagtcctttgtcaaatgtataggttgtgaagattttttcctactctgtgggttgtctgtttactctgctgactgttccttttgctgtgcaaaagctctttagtttaattaagtcccagatgtttatctttgtttttatcgtatttgcttttgggttcttgatcatgaaatctttgcctaagccaatgtctagaagggtttttctgatgttatattctagaatttttatagtttatagttttatagttatacttaagtccttaattcatcctgtgttgatttttgtataaggtgaaagacgaggatccaatttcattctcctacatgtagctagccaattatcccagcaccatttgttgaaaagggtgtcctttccccactttatgtttttatttgccttgttgaaggtcagttggctgtaagtatttgggtttatttctgggttctctattctattccactggtctatgtgcctatttttataccagtgccatgctactttggtgactatggtcatatagtatagtttgaaatcgggtagtgtgatgcttctagatttgttctttttgcttagtcttgttttggctatgtgggctctttttttgttccatgtgaattttagaatagtttttttctggccaggtgcagtggcccacacctgcaatcccagcactttgggaggctgaggcagagggatcacctgaggtcaggagtttgagaccagcctggccaacatggcaaaactctgtctctactaaaattacaaaaattagccaggtgtggtggtgggcacctgtaattccagctactggggaggctgaggcaggagaatagcttgagcccaggcgccagaggttgcagtgagctgagattacaccattgcactccagcctggtgacaaccatgagactctgtctcaaaaaaacaaaacaaaacaaaacaaaaaaccaaaaagaatagtttttctaattctgtaaagaatgatggtggtattttgataggggttgcgttaaatttgtcgattgcttttggcagtgtggtcattttcacaatattgattctacctatccatgagcatgtgatatgtttccatttgtttgtgtcatctatgaattttttcagcagcgttttatagttttccttgtagaggtctttcaccacttggttagtatatttctaagtttttttttttgcagctgttgtaaaaggggttgagttcttgatttgattctctgcttggttgctgttggtgtacaggagaccttctgatttgtgtatgttaatcttgtatccagaaactttgctgaattctttgatcagttctaggacctttctggaggagtctttagggttttcaaggtaaaggatcatatcatcagcaaacagtgacagtttgacttcccgtttaccaatttggatgtcctttatttctttctcttgtctgattgctctggctaggacttccagtagtgtgttgaagagtagtggtgggagtgggcatccttgccttgttccaattatgagaggaaatgctttcaacttttccccattcagtattatgttggctctgggtttgtcatagatagttttattacattgaggtatgtcccttatatgccgattttgctgagagttttaagaattttaatcataaagggatgctggattttgtcaaatgctttttctgcatttattgagatgatcatgtgatttttgtttttaattctgtttatgtggtgtatcacatttattgacttgcatgtgttaaactatccctgcgttcctggtataaaacccacttaatcatggtggattatctttttgatatgttgttggatttggttagctactatttcgttaaggattttagcatctgtgttcttcagggatatcttcagggtctgtagtttttttttttttctttctttttttggttatgtccctccctggttttggtattagggtgatgctggcttcatagaatgaattagaaagggttccctctttctctatcttgtgaaatagcatcaataggattggtaccaattcttctttgaatgtctggtagaattctgctgtgaatccatctggccctggactttattttgttggtaatttttaaattaccatttcaatcttgctgcttgttattggcctgtttagggtatctatttcttcctgatttaaccttggaggtttgtatttttctaggaatttattcatctcttctaggttttcaaatttatgtgcataaaggtatctcatagtagccttgaatgatcttttgtatttctgtggtgtcagttgtaatatctcccgttttgtttcttattgaggttatttggattttctctcttcttttcttggttgatcttgctaatgatatatcaattttatttatcttttcaaagtaccagctgtttgtgtttcatttatctattgtatttttcttgtttcaatttcatttagttctgctctgatcttggttattttctttcttctactgagttttggtttggtttgttcttgtttctctagttccttgaggtgtgaccttaaatgtcagtttgtgctctttgagtctttttgatgtaggcatttagggctatgaactttcctcttagcactgcctttgctgtatctcagaggttttgatagattgtgtcactattgtcattcagttcaaagaatttttaaatttccatcgtgattttatttttgacccaatgatcattcgggaccaggttatttaatttccatgtatttacatggttttgaaggttccttttggagttgatttccagttttattccgctgtagtctgagagagtgcttgatataatttcaattttcttaaatttattgaggctcattttgtggcctattgaataggccacatgtgctgttgaatagaatgtgtattctgcagttgttgaatgaaatgttctgtatatatctgttaagtccattcattccaagatatggtttaaatccattgtttctttgttgacttcctgtcttgatgacctatctagtgctgtcagtggagtattaaagtcccccactattattgtgttgctgtctatctcatttcttaggtctattagtaattgctttataaatttgggagctccagtgttaggtgcatatatgtttaggattgtgatattttcctgttggacaaggccttttaccattatataatgtccctctttgcctattttttcactgctgttgctttaaagttggttttgtctgatataagaatagctacctctgctcgcttttggtgtccatttgcatgaaacgacttgttccacccctttactttaagtttatgtgagtccttatgtattaggtgagtctcttgaaggcagcagatagttggttggtgaattcttatccattctacagttctgtatcttttaagtggagcatttaggccatttacattcaatgttaatattgagatgtgagttaccattccattcatcgtgctatttgttgcctgtataccttggttttttgtttttgtttttgctttttaaattgtatttttattgtataggtcctgtgagatttatgctttaaagaggttctgttttgatgtgtttccaggatttgtttcaaaatttagagatccttttagcagttcttatagtgccagcttggtagtggcaaattctcttagcatttgtttgtctgaaaaagactgtatcttttcttcatatatgatgcttaatttcactagacacaaaattctgggctgatacttgttttgtttgaggaggctgaagacagggccccaatcccttctaacttgtagggtttctgctgagaaatctgctgttaatctgataggttttcctttattggttacatggtgcttttacctcacagctcttaagagtctttcctttgccttaactttagataacctgatgacaatgtgtctaggcgatgattttttttttgcaataaatttcccgggtgcttttcgtggcttcttttatttggatgtctgggtctgtagcaaggctgggccgttttcctctgttattcccctaaatatattttccaaattttttatttctcttcttttgcaggaacagtgattattcttaggtttggttgtttagcataatcccagatttcttggaataagaatattttcttattcttttttctttgtctttattggattgggttaattcaaagacttttgagctctgaatttctttttttctacttgttcaattctgttgctgagactttccagagcattttgcatttctatatgtgtatccaatgtttccttaagtttttattgttttttctttatgctatagatttccttgaatatttctcccttcacttcttttattgttttttggatttccttgcattgggctttgcctttctctggtgcctccctgattagcttaataactaacctcctgaattctttttcaggtaaatcagagatttattcttagtttggatccattgctggtgagctagtgtgattttgggggatgttaaagagccttgttttgtcacattaccagagttgtttttctgtttctttctcatttgggtagcctctgtcagagggaaggtctagggctgaaggctgttttcagattcttttgtcctacgaggtgttccctggatgtagtactctccccgtttacctatgggtgtggcttcctgagcagagctgtagagattattatttctcttctgggtctggccaccaatatgtcttccaggctctgggctggtactgggggttgtctgcacagagccctgtgatgtgaactgtctatggatctcacagccgtggataccagcacctgttctggtggaggtggcaggggggtgaaacagactctgtgagggctcttagctttgatggtttaatgctctgtttttgtgctggttggcctccgaggccaggaggtggtgctttccagagagcatcagctgtagtagtatggagaggaactggcagtgggccaggcccttgagctcccaagagtatataccctttgtcttcagctaccagggtgggtagtgaaggaccatctgatgggggcagggtaggcatgtctgagctcagactctccttgggcgggtcttgctgtggctgctgtgggggatgcggatgagatttccaggtcaatgaaattgtgtacctaggagaattatggctgcctctgctgagtcatgcaagttgtcagggaagtggaggaaagccggcagtcataggcttcacccagctcccatgcaatctgaagggccagtctcactcccattttgcccctgatagagcactgggtctgtttccagatagtggggaagcagagctgagagcttgtcccagactacctgcctccaagctgcagaagaaaaggaggcttctcaactggttcaaattgttacgaagttcagctggagacttccttctccctgtggcatttatcccgtgccactggaccccctcccaaagtatccctgtgacactcccatggtctttcctgctgcttcctctacccctgtatttcactgggctctctaaattgattcagctccagttaaggttggaatcttctcccacagactagacttttagtttccccagtgtgggtgtgagtttaggggtggaggatctccctttcccacttccgcagtttgggcactcacagtatgtggggtgacttctgggtcctgcaggagcagtccgtttccttcagaaggtctgtgggtcctcttgggattcctgatttattcctgcagtcattctggagctaaaactcatgatgcaagcctccacatgctgctgtatccatgcgagtccaagctgcaatctagtcctgcctcccatctgccatgacgatcctaggtatagtcatatctaatacctgaatcatttagaatatatgtcatatctctagataagaagactaaatatcataaaatatctattttctctaaatcagatccaaatgaatttttttcaaaactcaaatgcttttaaaattaatttgcaagaataaatttctaaaatgtcatacacaatttttgaattaaaacaaataatcagtgtagacttcctcactaaaatttaaaatttcataaagtttatctgataaaaaataactcacaggagcacttgcatagaaaaagactaataactcagtgacacacaatatataggaacaaatgcaagcattttgggagaatttagtacatgatgcacatattatttaaaattggtggaattaagatgaattattcagcaaatgtattggaataactggctattaaaaataacattcaattttatacttcatatttttactccaaaatatattccagatataataaatatttaagtgtaaacccagaaacaatgtaagtactaaaaggaaatataggtgaatatttttaaaatcttgggatgggaggaaggtctttcaacgtaggtgatcaaggacaaagttaataagaatattgatagatttaactgaatgattttataatctttgcactaaaatcagcatataaggataaaatacaaataatatgctaagaaaatatttcagggtatataacagatgagatgcatcattaataggagttattacaaattaataataaagtttacaattctaacaaaaatgatcagtggcatgagcagggaagccataaaagaaatgtaaaggcacaaaaaacatgaaaagtaaccaaatacactgaaattaatggagatcttgtatcagttagctatttttgtgtaacaaacattcccaaaactcaatggttacaacagcaattatctgttgtaataatttacatttctttttgttgtctgagggtttgttggctgctttaggatgagcttaactgagcttgctcttgtttctgtatgcaggctgggggcctgtctctaagttgggctttcctgggacaatttagctggggcattcctgctccatttgtctttcatactctgcaagggctccatgtatttctcatcctttttctgggaccaatgagccagcccaagcatgtccttcttgtggaaatggcagaagtacaagagtgcaagcctagctggacaagtgtttcttaagctgctgcttgtgtcacatatgctaacatcccattggctaaatggcaattacatgaccaaactcagaatcaaggggaaaggaaatatatcttgtcttttaataggacaaactaaaaagtcatatgataaaggacatggatacaagcaagtgcaaagatttggggccattaatacaatataccagatgccgtcttttgcacgttggttagtagaagtgttttgtttttgttttttttttttttaaccttgcttgtaatagtcagtgtcgtcaagagtgttaggaaatgagtactcccacacactgctgaaggtgggagtctaaatggctaattggagtgacaatttgagtgtgtgtttcaaaattttattaaaggtgtgtgttttgggctcaatacttccatttttaagaatttactacaggaaaataattaggcaaatgtgcaaaggttgtataagtataaacctggttaatatagagccagttgtcatggcagcaggaggccatgtggagcagcggctgccatcaatcctggctgcagcagagaggtgtggctttggctgtatgcttcatggaactggtgggaactgggaacaagtgggagccctgccccttctgagttggggcaggagctccctgggtgccactgaagatgcccaagccacagcagtagacctgggcattcctgtgctctttgggcccaggagcaggcgggaggctcaccctcctgggcatagctgcagccactcaaactgtggctgcaggcccatgcctcctgctccatggagcaggcaggagccccatcccccagagtgtggctgcagctacccaaaccgtggctgtagacccaggcatctgtgcactcttaggcggtcttgagaaggcccccactgatcttacgggctcagaagtacctgttcccactgcctggtttctctctgctgttagcacctgcttctttcttggagcaaagatagggccaagcccaggcactgtcacagcccagctgggtgtgtgcacacttggggcagtgctgacatgccagcccctggtcaccttagccccctccagactttgggcactgatgagcataggaggaaagctgaggcaggctgagtgcagctcagtgctggcctgcaggtaccccttggcttctacagcctgggtgccctgaatgacagattgaggtagacaggttactggatggaagggggcaggtcacaggtgaggtcccagccttcaaagagagcctgaaggctggggactaggctgccagtaccgccggactggagtggaaacttgtggtgcattttccgggcctgcccatggccacccatggacaaattggtgtacacttcctcccctctgaggcccataaaaacccctggcttagccaaagcttagcagatattgaggtgaccagctgcatagaggagcaacacactctagggcctcctctctgctgagagctatagagacaatgagatgacctgcctgcagagaggagctacccactttagggcctcctctctgctgagagccacagagatgaaggagagatgacagggagatgatgggactacctgcctgcagagaggagcaccccattctagggcctcttctctgctgagagctgcacagacaatgggacgaccagctgcagagaggagctaccttctctgctgatacctgaatacttgtcaggatgacttgccttgaatacttgtcaggatgacttgcctagcagaaaggagcaaccctctctgctagaagctgaacacactttggggaaaccctggctgtggaaaggagctgccctctgagggtttcctctgagccattttattgctcagtaaacctcctcttcaccttgctcaccctacactttgctgcatacctcattcttcttaggtgtaggacaagaactcgggacccactgaatgaggctaaaagagctgtaacacaaatgaggctgagatatgccccattgctcaccacattgcaaacaaagagaaggaaagaagagctgcagcctttcagagagcccagacctgtgagctccccaagccagggctgtgactccctctttgggttcccggcatttccaagctactgggcatcaccatgttccctggtgccagctgcggaagctgctttcggtgcacctggtccagccgcagccttgtggaaagccgactctcatgctggcacctggagcttcctgccttgctgcagcagctggcatgtctgactgcacagtggctggaccccatgctcactcacatatcccttgtgctccacacagtctcccttggcagatgtgggatccaggctggtagtgtgagctgagcgcatcctgccaggccaagtgggcggaatgagcccagcgggcctgagtgaaactcaaggcaaaggcatcactggccacagaggtttctggccagaaaagtgacaccccaaagatcctgtaacagttgcacatgtaaggctatactttttaaaaaagttgacatcaattttgattgattgattgatatttcagcctgttatatattttaaatatcacctctgagttcaatgatattaatcactagattgtttataatagtaaacatttggaaaatttctaagttccattaatataaaattgataaaaataaatgttggtacatccacacaatgggttgctatacaactgttaagataatgatgcttgtatttattgtcatgaaagaaatccatgccataatgattaaatgtaaggtaggggcttgtttcaataatatatatggttgtatgttcattaaatatatgaaaaagtatttatcagggtatttctatgtggaaaattatgggtgcttttattttcttattgtgctttttaatgttttatttgtagtgtcatgcattaacaggcactttttatgaccattaaaagacagaaagtctacttctatttttgaaaagtgatattgagaatttaattgtaattagtttcaaggaaagcgtatgagtaacaatactctgttacaaagtcaaaacattccgtagaaaatagctatgagtcttaaaggaaagacttctctagtcatatcataaatgatgtctgtttcccttttgagcaaagagacacaacttaataaaattaataggggaaactcaaatgtatagaaaatagaatatgagtaagaaaggcatggatacttttatgctgtttatatacacatgtacacccagccatgctttctgtaaaaatagtgcttgcttggttctgtaaaaggaggaaatatttcagagtttatggcaaaatcattttggaagtacagaaggttggtttggaaaggattacacatttgtcatactttctttcatgcttaataaaaaaagtgattctgatctgatgaatggaacattgttagaagtcagaaaatattactgtttctcattatacttttcatttgtcacatgactttaatgaaggaccctcctgttagcatgagagtcattatcaaccaaaggtatatagaacgtttcctctttaatgcagacatttaacaaactaatgaatactaaaaataaaactctctaaaaataatgttgcttatatactgtgaggatctgctaaatcttttctgcttttgaatacacagtaagaaaattaatttagagcttaatcagccatcataagcagcagcaggtaattttatttaatttttcaaagcaatgagagactattggagtgggagcaggcatgcaggtaataaagaactctttgatttttattgaaacatccataatttaaatgacaggttttgcggattcaagactagtggtttgcagagggtgctctgcagagcctcttgggttccatgacattaccttggggcccactgagggtggtggttggaagaggaggaggctcctggctcccatgtccacatcctccactgtagctctaatttcataggttttgtatttcaatgttctgtgtgagttggcgtgaaaaatgagttctattgcaaaaatagttttgaaaacctttaatttgttccatctccacagtgtgtagatgaagaaacagattcaaagtagactcctgctctattttagtgattattaactcctggtaggtgtaagaatgcacaaaatgcttcagtcatcacaccaatcctgttacctaggctgagtaaatatcagcaccattgtttgccagattaggaaatggacactcagagggtttcaacaatctgcccacgagatggtatgcctaactcctagtcctgcttctcctccttctattccttctttaaagtactttttatctgaccaggctgtgtggttctctatgtttgtacatgttccaacccagagaagttgtagtgtataattgatagtattttaaaatgattccactgaagctgccattattagaaatgattgatctctaaacagcagcactatgtatgaatatgtccaataatgacaaactctaaccagtaagtgctcagaatagtgtgaaagttttatttagcaattttacaagattggtgtggagaatatatacaaattgctttctgtgtttttcttttttagcaggttttaataaatgatatatttataattttaaaagttatattaaagacctataatttgaacattgtagcattgcaagcataaatgttctttatgtttacaaaaaacctcaatggtattcttgattttaaattggtctttgtgtatattatattcctctcaagtgcactaaatttctatagattctgtatgttcattaaaaatatttgctcagttcaattacagttattgggattaggggtagcgggtggggaaaatgtgtaagttcctgaggcttccctaaatgggatgtcctctctgtggattgagacatgtccaaaaacccacatcgaaccttcaaggatctattacttgaggggcctgagagtctatgaaaaacaggcattttaagaagagtcctggctcaaattttgtttcatatctcgtcatatcaaaataaataagaataaaaaattacaataattgtgttatttttctatgtgaatatatatacacacagcagattttatttaaccatttcctctgttattaaggaacttaaaacatttaagatatttccgaatcttcgccattgtttaaaataacactgaaatgagcatctgggtgcatatgtaattgcattcatctctaataatttccattggaaagattcctattaatgacattgtcgtactaatttactctttcatcaatttaaaataatccttatactgccaaattttactaatattgaattatacattattttactaatattgctgatgaaaaattgtgtcctggtgactttttttcatatatctaccagtatgtttttgtcatctgtaagtggcatggagagcttataatttttgacatctctgatttatgtaaaatcatatatggaattagagaacctatgacattaaattaggttatctctggattgagaaatggtgatatttgttttcctcattctttttgtgagtttctgcccataaaatattttataataaaaatgcaaaaaagatgaaggtatctttttttacaaaacagcatacagtaagacaagattcatgtgtattatctaacatttatgaaattttattattaagtgtttttagaggacttattcaacatatgaaggattttagtcagtagacacagtgcctcttcacctgcactggaggcgttgtttttcttctctgtagcagggtgaatggggtaggatggtaaaaatttccactgagaatgtagcaaacttgatgtcttcaaaacagctccagcatttgtgagatgatgaatactccacatgaaagaggagacacagcgcagtggttagtgcacagccctggagtcgaaatccttagatattactccaggctttaccacttcttatgtgaccttgagcaagataaattttttatgcctcagtttcctcatctgtgaaatggggatataaacagaacctatatcttaagggtattataaagattaaatgaggtaactatgcagaaaacgtttagaaattctgacaataaattgttttaaaatggcaattataactttagtaagtggtctcatattctctctttttttaaaaattttactttaagttctggggtacatgtgcagaacatgcaggtttgttacataggtgtacatgtgccttagcagtgtgctgatcacggtcttcttatgcacatttaccaatttcagtttgttgaaagacacaattatcagatatttgaatgtggatgaggtttgttgtaattacaatttcacttgccttttgtgaatgtttctgtcacaccagggcatggggatgacatgaacaaaggcagagcagtggaaaagcataaacttgttcagggaatagtaaaaaatctaggtaaatccacaacataatgctattgtaacatactattaattatgttaattaaacaattattcatgtttggtcttcatgtcaagatgaaatatatttaaatacttgactttataacatatataatattgatgtaatatcataaaatatttgtaaaataaacacagttatataccatgtaaatatatttcatgtattcattctaatctaccgccaagtagtaaagtttcagatttttttttttttttgagacagagtcttgctctgttgcccaggctggagtgcaatggcatgatcttggctcactgcaacctccgcctcccaagttcaagcaattctcgtgcctcaccctcccgagtggctgggattacaggcgtgagccactacgccccactaattttggtatttttagtagagacggggtttcgccatgttggtcaggctgatctcgagctcccgacctcagatgatccgcctgcctcggccttccaaagtgctgggattacaggcatgagccactgcgcccagccttggataatttttaactctggaggagcagaaatgaagcactgtccggaataattttcctactagagaagcaagtgatgaccctgcgttacaaggggtttatatgctggcctagtatctatgttctctagatggcagtggtaggatctcactcccataacacccaagagtcactgcattataaggaacctagaattgctttcttttttttccgagaccgagtttcactctgtcacccaggctggagtgcagtggcgtgatctcggctcactgcaacctccgcctcctgagttcaagcaattctactgcctccgcctcctgagtagctaggattacaggcgtgtgccaccatgcctggctaatttttgtattttgagtagagacggggtttcaccacattggtcaggctggtctcgaactcctgacctcgtgatccgcccacctcggcctcccaaaattctgggattacaggcaagcgccaccgtgcccagcctagagttgctttcttaaaagcatccattatgtattagagaatacattacaacatttgcgatgaataatcaagcaaagattcaatatatcaccctgtttaaagtggaaatccacctccaatgattttgctgataatgatagaatgatataatttcaaaaatcattcttttaatttttgcattataaaaatttttgggccatgtgcggtggctcacgcctgtaatcctagcactttgggaggcctaggcgggtggatcacttgtggtcaggagttcaagaccagcctggccaacatagtgaaaccccgtctctaccaaaaatacaaaaattagccaggcatggtggcgggtgcctgtaatccaagctactctgtaggctgaggcaggagaaacgcttaaacccaggaggcagaagttgcagtgagccgagattgtgccactgcactccagcctgggagacagagcaagactccgtctcgataaataaataaataaataaataaataaataaataaataaataaatatttgatatgagtgatggactaaaaatctcaactaaatattcctgggactcttcattctgttctctaacagaaccttcaaagtgtattttggaaaaattccattaacacgctgcctaggctgaaataatttcatgatcagtttcatttttgcactcaccttgtaaatccagacctccaggcaggtgtcgggcagttatcagtggattaatctggtcagctgcttctggttgctgttttaaggttactacctaatgtgtacttttagagactctccctagtgtgctgtcacaaagaagtcgattggatttttatgtaaagaagggctcggtgagcctctaatccttaaatcattcctttgaccacattttatttcattgtaaatggagattaccacacagaggaatatctgatgctgtctggctgatccatttctaactaaacaattaagtcacttgtatgtcagagcatactctcagcaactggcatttccattacttcaggcttaccctgagactattttggaaatatttcatcttctgctattttttttctagacatttgttattttatttttagattgacagacaaaattgtatatcttcatctgtacaacgtgatgttttgaagtgcatatgcattgtgaaatgaatgaatgtagctaattaacgtatgcattacctcacataatcatcacgtttttgtggtgaggacacttaacatccactctctgagcattttgcaggaatacaatatattgttattaactctggttacaatgttgtacaatagaactcttcaatttattccttctatttaactgaaatcttgtaccctttgaccaatgtcaccccaagcaccccacctgcaactgcaactgcccccactcctctactctctagttccaggagattaatttttttacattccacatatgaaggagatcatatatttgtctttttgtgcctggcttatttcacttaacataatgtcctttaggttcatccatgttgttaaaaatggcaggatttccttctttttttatggctgaatagtgtttcattatgtttctatatgacagtttctttatccattcactgatggagtcaggtggattccatttttttggctattaggaataatgctgcagtgaacatgaaagtacaaataactctgacatactgatttcatttcctttggatatatacatgattatatccaccagtgggattgctggattgtatggtagttctatttgtaattgttttgagaaacttctatattgttttccataatggttgtactaatttttattcccaccaacagtgtgcaaggtgggtcattcacatcctggccaacacttatcttttgtctttttgataatagacactaatgggattttctcatacacatttaccaaacttcagtttgctgcagaacacaattaccagatatttcagtgggggcaagggttgttgtaattacaatttcacttgccttttgtgaatgtccctgtgataccaaggcatgggaatgacatgtgtagaggcagaacaatatcactccataaagatatcatctctcattgtgattttaatttgcattttcctgataattagtgatgttgagcatttttttcacataccagttggatatttgtatgtcttattttaagagatgtttatttaggtcctttgcccatttttaaattgggtttttcgttttcttgacttaagccccttaaatattttggctattaaccctttatcaggtgtatagtttgcaaatatcttctcccattgcgttggttgtttcttcactctgttgattgtttactttattgtgcagaagctttttactttgatgtaatactgcttgtctatttttgcttttgttgcctgtgcttcgggggtcatatccaaaaaatcattgcccagaccaatgtaatagagcttttcccctatgttttcttccagtagtttcatagcttcaggttttacatttaagtctctactccagtttgagttgattttcgtatatggtgtgagagaagagtctattttcattcttttgcatgtggatattcagttttcccaacaccatttattgaagagattgtcctttcctcactgtgtgttcttggcacttttgttgaaaatgagttggctggaaaagcctggatttatttctgggctctctattctgttccacttgttgtgtctgtttttatgcctgtaccatgctattttgattactatagatttgtagactattttgaattcaggtagtgaatacgtgctaattttcaattagcagaaagctcaagcaaaacaccctgagtataaatgaagcagctctttatgtggccttcacgaggattggactctcatagggcttggtttttgtataactcttagttttaactacatcctaaggttctagagaaaattctggagctgagacttagctatgcatttgtacaacttccttgtctgccaatctaaaagtcaatcttactgataatccctatttttcttttattcttatttcctcttaccattgtttagtagctaatatactatgtatttcacttgcttatgtgtttattgtctgtcaaccccatcatagctccatgagcatagcaccacgggggcagaaattatctactttgttcattgtcatagtcacagtgtcaagaaaagtgtctggcacattgcatgtgtataataaataattttgaataacagccagtcaccctattttatatatcctattttagtatcttggcatgggagataatttcatgagtatttatatatttgcaaactttggaagaaaaaaagaaaaaacactctatagaaggcaaattgagaggactgaaagtttagaagtgacaaacaacctagaaatagctacacatttttagtgatcaaaatcaatttttgtcattaatctggatttactaacttctcaaagttatcatggatgtaaaagtggctttaatctgctgatgctctgtggtgttctacaaaattgctaaattgcttttatgtgaaactggataagacataacccttctcctaccttttatattattttttagccatgagccaaatttttctagctaagccaatttaaaaaatattagaaatgcaaatgtattgccattgttctaaaatgtagttttaaaattccatttttcaaggtgggatttgtgattatgtgtgaggcgcttcattgtctctcagcacttcccaaccaaaatcagtccattttgccactcctgaggaaaggtctgctctgtgtgactcacagttacttccatgaatatttatcctgcctgtactgttggaatcaccttgagatcatgtacaattagttagggttgatagaattagtaatgttactggttgtgttacagcatctacgggtctcagtgaagtgggactcagtcccttctccccattactctattttctgtcccttcttgattctgcttgccattttgggggtgccaatttatttccttagtaaaaacaacagtagttatatattaagatacaactgtattatttgctttttttcttaaatccactattattttttgtcttttcattgattaaacttcaggcaaaactcatttggctgtgttgaataacattttgcaattttcttttccctgtgtctttcacactttgtagcattgtgctcatgtatactgtctttgtaagttcgaatctattaagtgatggttcgtcataaatcctgtataatacttgattttcatcatttatttatattttgtcacctgtactctcttgtcctgagtacaaagaatacacattcatctctgtaccttttttgtttattgatagtttatactttctttggacaacttttaaatgtatatttatttatatttgcttatccaatcttataaagaacaatttcacaagtagttagtccctgctcatcttcttttgatattcctaatatagtcttgtaatggattacttgggatatttattcctctgtattttaaaatcatgaatctcaaacatctctatccaccaaagaatcttttgaactaaaaaacgcacacagacagaccacatttttgaaggattcaatttcaaaataaagttagttcctacttagccttgcaaaatgaggtatcttctcttgataaagttgtgcaaataatgaatttcaatcattgaatattctaaaaatgtgttatcttgcctaagtaattgtttctatgcctttagctattaaaaatatgaaaacataatcctttataaaagcacatatttttaccttccatttgagtaatttttattagtcaaggaattttgtataggtatatatttggtgaaactttttaataaaattgtgtttttctggttataaaatgatgcagtttcattaaaaacatttataaagcagaaaaatacatagaatataaaaatcatccatattttcatagccagcaaatcattgttatcttaaaagtacatgtctataaacaataatttttaatggaattgggatcatttataagttcatttactacttgtctcttaacaataatgtataatctaatggttagtggaaaattcatcatatgatgttttcactatttaataaattcctcattcttagacatttagattgttttcatatttttcactgttatatataatgatgtgatgaacatttttgaaaataaataatcatagggttttctcttaactgccttacatacttcatttggagttaaatcactgagtaaaaagattcacatctcctcccacactctgccttctcttatgtgatttagtaccttttgcttgccttaatctctttctgcaaagtaagaaagtgatctgaaaaactaatttatatacagtgttgttaacttgtacgtgttttcctgcccctttcccttgctcagctgtcctagaccaattttgggaagcagactccacagacagaggtttatttgcaggagatttagtggggaatgttgtcagcaacaatacaattaagggagtaagggaagggggttgagcaggagaggctgaactcgggtgcaataacaggaaggtctccagccatcccaaggggagctctggagctcagaaggaccctcagagtgttcttgaattgaaatacatctctgaatccaacttcctcctgccactcccattgaccagtccttagtttggtatagggtgccttgggcaaggcagtggacatgctcagtagctgggtaagatgaggacttcatcccaaagtggccgtctgggcagtgaaccactgggtgttcagcgtatcagcctcgtggattttgtgttatcaaccaataaggggagagggggtgaagtgtaagtcaaaacagatgattctccactaggaaaattttagtctttcttgcctgttacctaaattggaaaatgtacatgaggaggatcttcctcagatcttgtcggcctctttctcataatcctgctctagaactcgaaatatcctgctctacgactcaaaaccaaacaaacattgttatttgttggtgaagggggcacctagaagcatttactgaccgagcagtgactttaacattattttatgtatcaatgtcaccagtttagaggatttcactatattaacaagtcctactgtgaaaataactatagtattactgattatataacaaggtgaaatactatattttgaccattaaactatttttttttaacttgggtgacatttagcaatttaccatttccagcaatctaaatgtttatgtcacagaaatcacatattaaattatctggaaatttatttctcaggaggatcaccaaggcatcagaaaataataataattaataacacaactataacaacttgacgttttataaggacaaagtatacaggttaatcactaatattgtaatttttttaacagccattgaactaaattttgacaattgaaaagaatttaattatgaactcctgatgatttgcctcccacctccaaatagtccacccatcattctttatgaaatatttattgtataggggctgggtgtggtggttcacgcctgtaatcccagcactttgggaggccaaggcaggaggatcacttgaggtcaggagtttgagactagtataagcaacagtgtgagatcctctctctaaaatatatatatataatttattgcataggaagtattttggggggatagtttaattactgttgtacctggttgtacttgatgaatattcacattttttctgctctctaaaatgaaaatttagtatcatttaacaacactaagagacatcatggaagcacaattctttattgccgtattttggaataggggtaaataggatgagagttgtttaaaatacattttactctgtctctcccactgagtgaaactatgcatcctggacagaatacataaagcagatatttgaggaatctaaaaaataaataatagcagatgtagtgggaagaagaccagaatttgttcattttttcctctggtatcttctggcttagactcaaggcagcctgacacctgagagagcaccttgtcatagacacacagctgcagacgccatttagttcagactcaaagagcatgaaagtgacctcttgttagtggcagtggtggcagtgaacgctctcagaggctttaaattctgaaggaagagaactttgatttgaggaaatctggtcccaagatggcagagcaaactttcatgctgtttttctatctccatcctcccatcacttagtgtggatgcagcggcaggaagtaggtggcagagaagggggtaaataaaaccccagctttttggctgcaggactgaaaagaggagctcctaggaaccagtaagtaggaaagagatagcacagagggagaagcttgggaaaggggcccaatggagttgtttacaaatttctgagctctttttacggccacagtcctctggtgaggactgatagtagaatagtatgcttgtttatgtccttatctggttggatgcagcctttattatttatttatttattcagcaaaacatcttgtccttgttggcaagatgctctgtgaaatgtgatggagtctttttctaaggcagagtgacttatgttcaaaggctctctttacatatgggctccttacttagttgctcagcatctcaggcttgccatctagaaaatggatagaattctcactaccgtcaagaagtgttatgaggattaaatgaattaatgtacactaagcaactgaacctaacaaatgtttctttccctgtggcatttggtttttagctttcctatccatttcctaagtatcaggcccttaggtttcatgtttagcactcctttaatctgtcaagtttactaagttgtaggataatttagaagcttcctaagaatcacatgttaaataaaaaaagaacaaaggtcttaaaggaaggagtgctaagataaaacctatggtaacctgctgccctttttcttacttctgaagagttgaggttgtcagaaaactaatatttagatatgggcttatctggttcataatattctaaacaacactgctaccattactattattaccaactaaaactatttaggatgtgtcaggtattgacattctacatatattaatttatttaattcttacaataacatgataaggtgggtaccattattattctaattttacagaatacataacaaaaacatcactttattgccctagtcttgttattcatattattaaaaaaacaactattgtgtactggtcttaaattaactataaaattagttaatatttggttatctctttaggataaaaactctagctaaaatgagccttaatatgggcaatgctttttttcctgctccataaaacagaccaaccctccttgcaagcttaaggctaaaaacccagaatgtaataacaactggaatgttggagatgcatcaaggtttttgcaatgtaaattccttccattaccttagttcaggtcctaagcttctctagtttaaattattacgattgatttctttttatttatttatttattggttttgagacggagtctcgctgtctcccaggctggcgtgcagtggcgcgatctcagctcactgcaacctctgcctcccaggttcaagcgattctcctgcctcagcctcctgagtagctgggactacaggcacctgccaccacacccagctaatttttgtatttttagtagagacggggtttcaccatgttggccaggctggtcttgaactcctgacctcaggtaatccacctgccttggcctgctaaagtgctgagattacaggcatgagctgttgtgcccagcctattacaattgatttcttactgagcataccaatctcttcttcattgactgcatactccaccctcactgcttgaattatttttattatttacatgcctggtttaaaaaataatggctgctcaataaagtaggacctttttctttcttttttttttttttgactgagcacaggggactttagtaataggacgtgacaaggtggagctccctaggcccctcccttttcaggtggtctgtgtggaaattgtgaagaggggagatcctcagtgttgtgaggtctgagtgcagcagggactccccagcagctgggggcctctctcttcctcttatactctcgctggggctggtggtccgggggccttattccttggaagccatgtgggccatgaggtccaccaccctgttgctgtagccaaattcattgtcataccaggaaatgagcttgacaaagtggtcgttgagggtaatgccagccccagcatcaaaggtggaagactgtgtgtcactgttgaagtcggaggagacaatctggtgctcagtgtagcccaggatgcccttgataggatcctctgaagcctgcttcatcatcttcttgatgtcataatatttggcaggttttccagatggcaggtcgggtccacgaccaacaccttggcagtggggacatgggaggccatgccagtgagcttcttgttcagctcagggatgaccttgaccattgccttggcagtgctagtagatgcaggtatgatgttctggagagccctgtggccatcaggccgcagtttcctgcaagggccatccacagttttctgggtggtagtgatgacatggactgtaatcatgagtctttcaacaataccagagttgtcatggatgaccttggccaggggcgctaagcagttggtggtacaggaggcattgctgatgatcttaaggctgttgtcatacttctcataattcactttcatcatgaacatgatggcttcagtagagggggcaaagatcatgacccttttggctcccctctgcaaatgagccccaaccttctccatggcggtgaagatgctggtggactccacaacgtactcagtgccagcatcgccccatttgattttggtgggatcttactcctggaagatggtaatgggatttccattgatgacaagcttcccattctcagccttgatggtgccatggaacttgccatgggtggaatcatactggagcatgtaggccaggtagttgaggtcaatgaaggggtcattgatggcaacaatatccactttaccagagttaaaagcagccctagtgaccaggcacccagtatagccaaattcgttgactctggccttcaccttcaccattgtgtctcagggatgtggcaggcgctgtgctgcacaagaaaatgcggctgtctctaatgggagaagggagccaaaatagggcttattctatgcttctaagaactgaatcctggcctcacttatttctctaatgctgtctcctctgactgaaagtaacaaacagaaagcccttgtccagtcacacaaatacagtcatcattcatgcctttgctgcagaatgtatctgtcactcttaattaagttgtgataataattttattgtttactatttattgaggacttacattgtaccagggtttgttctaagccctttatgtggacctattttatagataaaaaagctgaagtttagagaaatagtttgcccagcatcatacattctgtaagtggggttgctgagatttgaactctcggcattctaatacaagcctgagtttttagccatgatacatattgctacctgtttatttctcacattgaagaatggaaaggatcacactgacactgcaaacctaacatatacatcttgtttccaggaggcaataagataaattgcatggaaggtctgttgggaggaatttggatgttgttactgtcccttaccctgaaggtaattattaggtcttttgagcccagagcttggtaacagttgccagtgttgataagccaaaggtggggtattttcctttttcctctggttaaagatcaattcacttctttcatgttttctttttagctgatgataaaggagaagaataaaaggatgacagatgtgaatacttaatcacgttgcttaatattatggagtgacataaaaatatggtttgctttatctagacagatgtggttttataaaataatcatggtctttttgtttgccatgtagaataattatgcacaaaatgggagtgtacattctggaaaggtcatcttgacttttaaagggtttctttaggcattcatgattgtcactttctgatcagtatgggacaagttgggatacataaaactctattctgtgttaaaggaatatttcaaagattccatgtttaatgaaataaagtattgcctagaaattagagacttgtgattacttgcactgattcattctgaagttttctgaatgctcttttaaaaatctgtagctcttagtttcttatttctttcagatatcaagaaatgcggatttccaatgcacttagcttatgctcaatattaagtgaaataattaatttagcatgtccatgatgatactaaattagtaattcagggtagttaaaattgcagtggatgctgaactgatccaagaaacagtttcaaccttgtgaactggtttggaattagtagtctatcattaaatagtaattaaacatcaaaggcttgaaatggcccattatgtgcaacagaaagtttgtgtgttagaataagacacttgaattaatatatatttcataattttatatagcaattatgtggtgataaacagtataattattttattttttatgagttcattgtctacattttatattttacatagtagttatggagaaattgcctactctgtgatgataaacagaagactttttattatttttaaactcactttctaaaaatataacacaaaattggtttattttattttatttatttattttgagacaaggtctcactctgttgtccaggctgaaatgcaatggctcaatcttggcttgctgcaacctccacctcacaggctcaagtgatcctcccacctcagcctcccaagtagctaggactacagatgcaccactatactcagctaattaatttttttttttttttttttggagagacaaggtctcactgttttgccaaggctggtctcacactcccaggcccaagcgatcctctcatctcggcctcccaaagtgctggaattacaggcatgagccaccatgcccggctaattttcttttaaatccctatacagaatgtaatttgaatatggattttgtttttgtaactcatatttgaaaaatgtctcctttaaaaaaatcatacaaatattgaaagtatttgagattttttaacctaaatcaggaatttgttttaacatctgttatcagtcatctgaagccacaacacttggtttttagagccattccactttatgatgtgaacatgcatgatgcatgcaaggaagagtaacatttcatactatgtgcaaaattgtcaaaccttgtatctttggtatgtgggagattggggaagtgaaaaatgagtctgttttattaggggcagtggtatatcatggtgtatgggtcatcattgtgaatcacagggaaagtggcatagcatttgggattgatccacatgccaccagtaaatcttggcccaaatcaaatcgaaatagcacaggaattaagatagttaacatttggcagggcacggtggctcacgcctgtaatcccagcactttgggaggctgaggtgggcagatcacaaggtcaggagatcgagaccatcctggttaacacggtgaaaccccctctctactaaaaaaaacatacaaaaaattagctgggcatggtggcatgcacctgtagtcccagctacttgggagggtgaggcagaagaattgcttgaacctgggatggggaggttgcagtaattcgagatcgcgccactggactccagcctgggtgacagagcgagactccatctcaaaaaaaaaaaaaaaaaaaaaaaaaagctaacatttatcaatggttaattatgtacctggcacagttctaagtgtttaaagtgtattaaatcattaatcctcacaaaaaccttttaaaataaatactgttattaattagataccagcaggggtgagcattgtatagaggagcaaacaggtatggagtggttgagtagcttgctacacaactagaaagtggcggtgctgaaattgaactcgggcagtttggctacccagtcagcactcctaactattttattaaataaatatctccctcgggactttgattgaggtctaagtcatagaaatggtctgttttcctgaatttttcttcgttaagatgaaagttctaacttcctgccagtaaatgtctaatttatctggaatttgtatcttcaggatatttgagtcttagagtttgtttcattgtcccagtggtcagtctaatgttgagcttaagtcatttatgaattcagcccttttgtttttatgaagatgtagaaaatattctatggctttcttttccttttctttttgtagagacggagtctcgctctgtcgcccaggctggagtgcagtagcgcgatctctgctcactgcaacctccgcttccgggtttcaagcaattctcctgcctcagcctccccagtagctgggactacaggcacttgccgccacacccagctaaagaaaatattctatggctttcctgtgggttgctcctaagcttcctccaagatatttcttctttctcctctttccagaagcacagtcacccatctagcttgggctctctttagcctcctctgtagtaatcctaactctagtctccttacaatttattttctagattaacttaagcaatgttctgatcacaaactttactattgtctctccatttatcattatatacaatccaagtcccttaatgtgatagcccaatgtcttgttgctctggatctacctttcttttcttatcttaaaattcttaatcatcatggaagctaacatttattgagcacttactatataacaagcactgtgcttacttccaaacatacaaagatgaagaatagaacctactttctccctttgtgattatcacagggattatctcacttaatctttgtggaaaccatatgagctatgtaatattattaactccattttaatgaagaggagacaaagtcttgaagagtttatgtaacttattcaaggtcacaagagaaccatgtggtagatctgggattcacaccctcacttttaagccctatacaatactccccatgtcataaattttctaactctaacccatctttagacgtatggggctactcaccactccctttatatccctcacttttttctcttcattatcatgttttatgtcattttattctccttgtatgtaggtctcaatttttttccttatttctgcctattgagtaacaactgccttcaacctgtggatataattgacctctcccaccacagaaccaaagcttcatttattttcttaactcccatagtgctataaccttgtatgctgcttatacagactatatgatgagctttatcgagtgctaaaattttttttaagagtaaacgcttctaattatgtgtcataagtaagttctcagagaagctgattcagactttccaccaaagggttgtgttggtacagaaaacataaacatcaaccacattttagcacaattttcatcattctcttgtggtttgacttttctgatgatgtctaaacttagacataaaaggaaaccccgccttatatggatgacatggaatggaaaagaagctccatggctttcctgtttcactggtgggtttgaccttttccacacgtgcatttgctttgaactcctcctaagttaggtgctacgtgaatacaagttataattaacatgctttctttgggtctccttgaacaaaatgttctctctcatgatatgctatgcatatttactttgaatgaataatagttttgaatttggatttagaaagcagataatgtgactgaaatccatgtttcttctttgcctttaatctagggctgcaggatggggcccaaatgtgaagggaataaaacatgagagaaccttgtttagccacgagataaccagggataagagtttagcttataggctctaatcaaacgtgttatttttcattgaaaactggcgtatggtatcactatgcagctgttaaccagctgtttcctttctactggggttcttgtgtgctctctgctttaaatttatgtgttgcttgggatcccgaaggataaaatagtacttgtaggttcaaggtagtggttggaatggttgtttgcatgtttttagattttttagtttaaagcaacatgtttaaaatgttttcttctaattgctattgtgaatatgcaaatgtttatttaatcatgctcaagtgagagaagatatagaaacaattcataggctaattcaaaccatgtttttccctctcttgtttgccctacactaatctgccaagcctgtatgattgtctcagttctccatttagcaccgaagttagttttgaaccctgaaaaaagagacatttatatacttaattatttacatataataataaatatcgtggtcatgtaatggctacttcagtcattttatttccggaattggttccttccagtgggttcttggtctcgctgacttcaagaatgaagccatggaccctcgcagtgagtgttacagttcttaaagatggtgtgtccggagttcgttccttcagatgttcagatgtgtccagagtttcttccttctggtgggtttgtggtcttgctgacttcaggagtgaagccacagacctttgcagtgagtgttacagctcttaaaggtggcgcatccagacttgttcattcctccgggtgggtcgtgatcttgctgacttcaggagtgaagccacagacctttgcagtgagtgttacagctcttaaagatggcatgtccagggttgtttgtccctcccagtgggttcgtgatctcgctggcttcaagagtgaagctgcagaccttcgcagtgaatgttacagctcataaaggtagtgcagacccaaagagtgaacagcagcatgatttattgcaaagagtgaaagaacaaagcttccacagcgtggaaggggaccccagcgggttgccagggctggctcaggtggccagcttttagtcccttatttggccctgcccacgtcctgctgattcgtccattttacagagcgctgattggtctgtttttacagagtgctgattggtgcgtttacaaacctttagctagacacagagagctgattggtgcatttttacagagtgctgattggttcatttacaatcctttagctagacacagagtgctgattggtgcgtttacaatccttttgctaggcagaaaagttctccaagtctccagctgacccagaagcccaggcagcttcacctctcaatttcatgccttcactggcccgatgacagagtttcaccaacagaagaaaatctttcggtttgtcacagtgtgtatggtctgtggtcagatatgtcaaagaatggtaaacaaaggcctgtagacagtatatcagtgctatggtttgaatgtgtcctccaaagttcatgtgttggaatcttaattctcaatgccataggtttgagaggtgggacttttaagaaatggttaggttataagaccacatctggtctcatgaatggattaatgccattagtgcagcagtgaattagttgtcacaggagtgagttcctgatacatggataaatttggtccccttcttccccctctgtcatgctcttttgccttcctgtcttctgccatgggattacacagcaagagggtcctcacaagatacagccccttgattttggacttcccagcctgagccaaatacattcatgagccaaatacatttctttttttataaattacacagtcttaggtattttgttagagcagcatacaacagactaagacaattggaattcctactaaggattcacatggtatggagtttaaacataatggaatatgtttgtgttatcctttttattattggaaggttgagattttattattacaaggttgagattaggaaaataatacctaacaattataacacttactacacactaagttttctacatgtattaatttatttaaccttcttgataagtactgttaacatctttgttttataggtaaactgagacaaaacatgttaagaaaagtgtacatggttacacaacttgtaataatcagagaaggatttagatgttggtaggttagctctttactctgtactagactgccttgagttgttgcaaggagttaataattaatcagattactaatttcagaagtagtccagtggcatgtgcctctataattcctgtgtttggtatgtttgattaacttcccctaaacttttagaactctttttcatgattgctggggagcaccagtgtgggggcagcaaagcttctatctagaagatcagttaagtcaagataaggaattcacagtaggtgtattaggatatatcagggtgtactagtcaatgtcaaccaaatgcagagtgagttgagctgggattactatatcatgctccaacaattcaaagttttcatggggatctctcttttctgaaaccaagtctaaaactctcatacctctcatgtgaatttatgttaaatttcagagcattcaaagattttctcaccctaatgttcccttgaattaactagatcaaactgctgagctcataggaggggcttctgaaatatgtttgcttgtttgcttttgcttttggatagatggataagtggataattgagagaaagaaaaataaagttcatattaataaaattgtaacttgccatatttcattttgttaccaggaagtaatgacagtctttaaatgacttagtcttcctccaaggcattgtctcctgctaagcctcaataggcaggtagggaagagaagctattgagagagggagtgctctatagatagttttcttttttcttcctgaccacagttagcacagaatatggaatcatttaatctccatgttatctttggtgggggccaggaatataaggaggaacagaagctaaaataacaccaccaccaccaacacagagaagctaaaatgaaattactgagttaatgactgagtcctctataacagcaacttaatatattggctgtgtaggccatgttattaaattgtggttccagtgagtatcttagagcaaataactatagcaaaagtactattaaattcttagcaaaccaataaatccatacctgccagttaagggcaaaagatatctaatttacacatttaagatgtatacatgctacatttggtttcagagcattggtttccttggatttaaagtgcatttgtacattaactagaaaaaattggtagactttaacaataaggtgaaatactcaaacctgggaagaaatcagtaggctttaactataagtttaaagagccaaaacaagccaccaaatgaaaaagtgaaagctcatgtgtgctttacacatagcagacgtgctagaaataattgagtaaatgtagatggacatgaataggtggagaaaaacctatgaattaatggcaccaaaatctcaggttctacttggggaacgaggctctgccgtctggggaggtaaagtgagctagtaaaatgacatgatcaaccattgctaggataagctgtttagtcagaacactagctaaggtctcagctaaggagaatgagtaagtggtaatcatatttgagtaagtggtaatcatatttaaagactcagagatcaacagaagcaaactcctttattatttatttgttattattattggggatctcactctgtcaccccggctggagtgcagtggaatgagtatagcttactgcagtcttgaacccctgggctcaaatgatcttcccacttcagcctctcgagtagggtgtaaaccatcatgtccagtgcaaagtcctttataaggtggcatacttgccttgggtaaagacaaagatgaccagtgttggtgagcagtgttatccagtagatccagatgttttgctgtcaagatcaagaaagtaggtaaggcaaaagaacgggcccagtcagagcagaacacaggggctgcccttgggagaaaagtgggactaaacagcatttgggatcagaaaatcattttaatatgatgattcagggtattttactagcccactttcgaattctcttcacctaatcattataaagactcctatggctggtgattcagagagctcacaaagtctaaattgcatgtacaaaaggataaatgtaaaattttgcacttagcttaagaaacaagtggatgatgggtagggagaacaagctcagtcacactttgcaggaaaacaaaacaaaacaaaacattgcattaggaattttaaaatttaatcttaactgccacaagtcaactgtgtgacttttggcacaagatcttttaaaaccttaatttccttatctgagaaagaggatgttggaagaagatcgtctctgaggttcttcctggatttaattttgtagttctatggcgtcgagttttcttttaagtaccaattcatatgaagcaatgttgtgacatgtgatgccaaaaatctaattcattaggagaaatacagagactagattatcctactgtattcagtgtagtcgcttcatttggctggacaatcaagttatggttgccatatattttgaaggatattaaaaaaattataggagatctagaggaagttgactgaggtgtttattattgtagaaacaattgtatagaagaaaacatgagatgaactagggttcattagcccaggccagagaagaagggggcactcagtaactttcttccagtatcccctctcatagctctagatggaaggctgtaggaagattttccctaaaggctacataaaaagaaataaaaagacaaaccttcaaataattgcagtgttccagtagtaaactggattgctttgtgatgaaacgatttccctcacaaggatgatgttcaggcaaaagttgaaagaccatctctgcagggaaagctggatttgatgatcttgagggtcccaggcactcacaggtgcttccatcttatgatttgctcagtcttgacattagttttgaaattacaataaaaacaaatttatgtgctaatatcagaagtgataaatttttatggcaaactattttctgattaatcagaaataaaatattataattgtcaaaactcagacaatttcatttagttctatataaagaactattgaaaacagcaacatgatctggaggtttttacagttcctcttgctccttggcgtctttatccttcaagagcatttctctgagtgtatttctttcacatctaattctgtcttggtgcctgcttcttggagaatctgagttgacctagtaataaacacacaataaatattagcaattttctcttactctttcctctgtgactcaaaagcaatttgttttcttcctgtgaatagtttgtttactgttggtggatatagaattaaagtgagttagaattttatgttgtttttcctaacggaaccatggaaacgttcttgctgtttgatagttacaaaatgcctcctgattttaggcggatagtaacaatttagaattgaattgtaaacagcatttgggaccagaaaatcattttaatatgatgattcagggtattttactagtaaaaatacttaatatcacttagtatttagacttcacatctaactggactagatgactatttatgtgtagacaggacttagaggcggaacagcaggaggaaatgtagaaagtcaaacacctggctagggaaaagtccttacgctgtctggatttggtgtcagcctccgctctgtctccaccactagcatttccagccaatgcatccctgattactcaaagccaagcatttcctgcagagtagcaggagggataggaaacagcatgtgcttcctggtctgggaggtggcacaggactgcggggcagccagtaatagcaaacacctaaagcgggaaaggatttggtgaccctgtgaacagaactttgcttttcagcagaatgacacaatcatctgtagcattttagtctggatttaagtcataactactgagaacacactcactgtagaatctttgcttttggggcaccagtgtaataaggtagacaggactgatactgacttactcaggggagagaaacaaagatacacccagctcttccggagcatggggtgcccttggtggaaataagcaaacattatttttttgccctggggtcagttaaggtcattcaggaatcacttcattgagaaggacagtcttgaagagagtccaagagaaaaagcataaagttatgctttgagtggagggaagggtataatcattccagttaaagggaattgctgtcgatcacagctctgaagcagagagaatgatttgttaaccagggccgtgaacttaggtttacctttgaagttcttaaacactgtataaagctgcatattttaagaagtagagtgagccttaaatatttaaattatttaaatgtgtatctctcttgtagggcatgggaagaggaccatagtttctgtggcctccctaagatggcctgccacctctcctgatgctggtgacttcttgtgatggtggggcaatattaagtgtttgaaaaaggaagaagttcttattcccaagtgagagaccatataaacatagaaattaaagacaagggatttggatgaggtgtggatatgaattacagttttatttcttgctagtcatgtcaccctgggagagttacttcatctttctgagcttcagtttccttatgtaaaggaatggtgacaatattagctcctatcacaaaggatttttgtgagaattcagtgagatgtgccatgtacaatgtttagcacacagtgccagaaatattttatgggagcacagattcaaaaatgactaattagagcagttactgaggcgtctcagtgcaacagctgtgtttattattgaattgcctgcaaaaatgggcacacatggctttttaaaattttttattaaaagttagtaatttatgatggctttattaaaatacatgactagtgtaactggcttttatcacatagaacagtttatgttttcattagtgagacgaaaagaaaaagatttcctgcatcctgaattagagctatcatctgttaaaaatatttatgactaagaaacaaaagatacttgtttttacaagataggagctcaatatataattacaaaatgaatagattcacctatttattaaatacatatttgttttaaataatgataagtgctaatgggggatatgatagggattgggctgtgtgtgtttgtagatattgtagtgttctgaaatttagattgggcactagtcttaatgtctaaattccaaaattacttgaaaattgcaacttctattaagtgtgctcaacctaaaagtttccagaaggtttacgataacattcaagtttaaattcaacataattgcgaaaagttgtattttgtttattttcagagtttatgaactttttctgatgttttcctaatatatgaaaatgaaattgggaaaaaaagttagtttcagtaattggacctacatccttcagcgtggatttgtttccccgtttggctaatgtttcattgacctctacaaggctggcatttctagaataccaaccgagtaaattttagactctccacagttgatttttgttgaagctatcagaaaccatcaagaactcatttgataattataagtttttgtgtttgtatagtagttaatttgcaatcatgtgctgttttgttgaatgtttgaagttggcttgctattgatgtccttttctaggatgcattttccacatagaaaagaatacatgcctgagttctcaggtttatttgttcatttaaaaataatttatcaagtgcctatcatgtgctacatggttctagtattaaattgaaccccatgccactgtgggtattctatcctttttaactcaaaagtcagaaatttgatatagttcaacttattcaaaaacaagtcccctttaaagagctttcaatctaatataaggttttaggtgtataaaaaaagaatgcctctaaaagtttttatacttcattaaaaattttgtggccatggaattctaaaattctgtagatcagaaatatttctatataatgaaatatacaatgaaaatatttcagtataatgaagttatttccctgatgcaaggtctcatttagaagagtttgttttctgcatgaagcatccaaagtaataaatgatttcttcatccttgcgccgtgccgtatcatcaagaattacttatttgtccattttgttgtgatttttaaagctaatttagaatcaaaactgaagtgagaagttgaacagtagcccagttttgttcctgcttggaagaagtaattaatctttaacttcccgtatttctacctactctctttcaaaagcacaaataattttccttaccagaaacctcctaaatttcatagcattcacagtatacactgacatgatgtaggagaggtgacatgttatgtgcttgaattcagagttttttcccccgttctttttgatttaatgcctgaaaagagtagtggcatatggactctgttcttattcaaagcccaattatggtatgattcctggcaaaaacgttcaccattatacaagtccacaaagggctttgaattattgaccctactcagtaaacaagagagctccttgttgttggtcccactggggatgggggagcacaggcaaggtagtggaaggcataaaaaaggaaagcaaggagagatgaatatgcaaaatgctgttattttaaaccctcttgttttagtttacattcaaggaattgtatgtaatggagagggcacagaattaaaaactaaaatgatgggattccaagcaggctaaacttaaagtaccttcctaacgacaagcctacctgcctctgtacccattgtttccccctcccattttggttggaggtgacactccttgccattgggccaatcctcttaccaacatcagaagcccacttctttcttatcatgtttttatcatcctccttctcttctatatcttctccttctctctttctactggattttcctcatcagcatttaaacatatggaagtcttttaatttataaacatctctttatcctattttcccctcctgttaccaccctaatcctttccatctttacctgtgcataagaagtagcacagcaaggcaacacttgtctttactcaacagctccatttccttagctctcattcattaattaatcttcctctgaaagggctaaaccaaagttatcaatcatctccctgaagctaagttcgacaaacattaataagtttcttatcacttaccctcttatcaaagcacaacaaagctgaccatgccactccagtagatcctccactgacttggtttccatgatactagatccgtttggattgtctactgcctcttcagttgctccttctccttcttcatttaccagccagtgctcctcatctgatctgaaacgctggacttcttcaagcttcaatcttcggctctcttttcttctccttagaccaagatttctcaatagcttttgggtcttaaagaatccttgacaaaaaattattgctgaacttccagtatatcagcatgatcagtaagttgcagacataataaactaaaaatactattaatactcttttggagatagaatgatagttttctatggatatgtttattttggctaatattatcagcccactcattttgtgtggttctcctcccactaaggatatcaacttgaatgtaagtcaatagtatgagtagcgcaaactttagtttttctttttttttttaaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcctgggtgacagagcaagagtccatctaaaaaaaaaaaaaaaacaaaaaatgaccaaaaacccccccaaacccatacattctactataaaaaatgcaaacacggtatggtatgtggtacatggtgaatggcaagagtgctttttccctatttacaactaaagatgacttgttagctaacctttcttgaaaaaagaaaggcaataagcttagcttgtcttttaaaaatttaattcctttattttcaataattcttaaaacccatgggttaacatagtaaatttctgttaataaataactggcttaagccaaaataatttttaaattgtatttacttagaagcattcaaaatgtcaacaacatggctgcaactgtttttttttttttacaattatagagttgtattcagttatcaaaacaacaattattttgtataaactgcatcagagacaactgaagatgaaagaactaccatctccacatataactaatttgtgcagtgcaccagaaagaacctgtttaaatttccatgccaatttgcaacccccatactgtgccaggtaaggttagtggctattgaaaatactacctggacagggctatctaaagacacattggatagtgtgttaactatataaaaaaagacactgtacaatttaaaaacaaattttatacagacttacatttcaatttgtttctttaaaaagtagtcagttgtgtacaggggggttaaatgcttttaagacaagaaaaacactgcactagaaccaacttattaacattgtcattatctcctcctcctcctccttctcctcttcctcctcctccttcttccttcttcttctccctcttcttcatcttcatcttcttcatctttttttcatcttcctcctcttccttcttgttcttactccctttttttttggctacatcagtctttcctttagcttactgtgcagcaatattctttgggtatttttccttcagccttgcatccttctttttataaggctgcctgtcatctgcagcagtgtcattccatgtctctcccagtttctttgcaacaatggataggctgggatgttctctttcgatttttgggtgatactcagaaaagaatgaggccaaaggaggcctcttgggtgcattggcatctttgaacttcttttttctttcttctttaggagggacatgggtttcatttctcttttgtaacgagtattgtctacctttgccatgtcttcaaatttttctttcttcttggcagacatggtcttccacctatctgggcacttcttagaaaactctgagaaattgaccgaacatttgggtgcttcttcttctgctcctcccagcaagtttacacaaagaatgctgtgaagatattttgcctcttggcttcttaggctctcctttgcccaagtttagttatttttcctcagcaaggcacagaattatccagaatcacccagtgcccatctggttctcacttgccctggcattgtctttatgcagctcaatgaactacaactgagatttacttttttaaaggtaaacttgatagatttaattaaataaaatttgtcagttgaatttaattaatattatttacaacacaaagatttgttgggaatgctgaatagtaaacctcttaaaataataagtcaaagcagtggaaataaaaatacagcttaggacatatataaaagtcaaagtcttacagattgcttgttggaatgtaaaattgtgttgtcactttggaaaacagttctgcaatttctcaaaaattaaatataggttttcatgtgccccaacaatttcaccactaggtatatactcaagagagcaaaaacatacgtttacacaaaagaattgtacatgatgtttatagcagcagtatttataatagccaaaaattacaaatctaattgtttatcaactaataaatgaataaataaaatgtgatatatccataaaaaaaaaagtcaaagtctttagtataaagctgtaacaaatcattttctttgtgagtgacatgattaggctcaaatatagacctagaagttacaaaattgttatgcagatgtgtgttggttttccaatctcttttataggcctaaatatttttaaaagtattatttgaaccaaaaggaaagaatgaaatttacacatgtaatttcaaacttggtttttgctgcaaaaatactcaattctaggtcaaatatatgaagtaagcattcaactacttcattttcaactatgatcagacaatttctgtccttgtttttggtgtttcttaaataagaaaatgttgctcataaatcaaaaaagttgaaaaccacagcaaaatattcactgcttcactgtaaatggcaggatactctgtcttcacagaaacccagaactcatataggggcagaactcttattgtcatttgtaagaataatcagacttcatctcaaagttcttcctcttctctgaaaatcaagttctcatgtgaggagaaaatctagagaaagcatccctcaccaagtcagacacttggattgaagggaaaagtacactcagtgttgctctgcagttctctggatggttttcaatatgctcatatcctccttcaatttcaagcccaagcagcagttgaaacatttcacaatttccttctgtgacttgttttttcctaaagattcaatttctttaaattcaagaatcctgtcatttgaaacaaaaaaaaagtttctgggccatacaaagacttgttcatctggataaggtgatggaaaatggctgctaaatagcctagtttctgcagccattctttatcttgaaaccctctagcaaaatctgacctactaatttcttgaaagtgctacctttcggttcaaacaccctgttgagaactcttcctctgctaactcactggatgtagaataaggtttgttaggtggcctccaatattctcataccatcttcaagccatcttcagtgaactggtctgtgtttaatagtaatcatccttgtagcattactcagatttttttttttcattttgtatttaagagttttcaacaccagtagctctctggaaataagtcagtgtcttgtgatgtcagtgtgaaggtgaattttcttggggcaccatcaacgcagatgccagtgccattcttgcaaaatagactttctgttttcagatataaagatgaagagaaaaagtatcttgtcctttacttgttttgggcaacatcctgcagtagaaaaaaaatgttcttaaatttcaacattatttataaatcttacaagtgctacagcatgatgtttattggtgaaatttgtttattcatcaaaatggacaaagaagctgtaatttttcaatgtattataaaaataccttcagcatcatgtggcatgccatcagtatgtcagcttattatgctgattgagagcgtgactttttcagttgcttgtatggaatctcattctagcattttcctaattatgaccttacctgctatcattattaagttctcaccaactatgcaacttttccttttctaggctacactttgtgctttggataactccaaaataacttgttttcagagccttttccttgagtgtgactgttttttagaacaaaatatttattttgtttgtttgagattcaaattattgtttaaaataatcagtatctttatttgttaaatggctgtaatttgtagttaaatgtcttttcaattttgctagttattgctgcatttttagttgtttggtattgactgtgcacaatagaatagatcaacttggatgtaaaactcattgttaagtagctttcattgtaaaggtgaactttcttttggattctctgcactgggggagtgaattgactcaaaagattttatttccttatccaaccttatcaaaactgtccagaagcctaagcctagaatctttcttttctatctcatacttcatcttcagaaatcatcaacccaatgttcagatatatttgtgaaacacaaatgcagataaaatataaaacagaaaggtacagcagggcacagtggctcacgcctgtaatcccagcactttgggaggccaaggagggcggatcacaaggtcaggaaattgagaccagcctggccaacatggtgaaacccgtctctactgaaaatacaaaaattagctgggtgtggtggcacacacctgtaatcccagctactccggaggctgaggcaggagaattgcttgaacccgggaggggacattgcagtgagctgagatcatgccattgcactccagcatgggcgccagggccatactccacctcaaaaaaatgagacaaaacaaaacataacaacaacaaaaaacaaaacagaaaggcacaatacctgagaaaatctcaagaaatgcaaaacctacaatacagtctatttttaacttaccgaattcacattcagcacttattacaacaacaagcagcagggatcagatgagtcttggtatgtataagtatcttctttagggtgaaaaggtcccactgattgtctgttacacctgtagagcttatttttttccttgtcagtaggttgtatataaagggaggtgggaaaggtaacttggagggagaaggtggacatcattttcctgccttcctcacctttgtgcagcataacactcaacagatatccaaggcctccctcacctggcatcaatatctgagaatggatgtatctaaataaatattgtcctatgtacattaggacaaaatctgatgtttaatatctctgcaatcagtatttcacatggaagctctcgagacatttagcagcccactaggattctgtagaacttctgttgagaaaacttgttgagacaatcttacctacactcatggcttcagttatctaatgctttcaaatttatgtctcctgttggttctggatttaaaattgctgactcgccatctcctcttgaacatttcataggcacatcaaactcagaatgcctaaacttaaattctcaattgtgtctctactccctccccaaccatgcaaaaaagaaaattgtgagccacttccagtgttgttcccctcagcaaatggcaccaatgtccactaactgcacaccccagcaacctggacatcattctttactcatttcccttaactgtacctcctattccatgtttaatcagtctctaattcctgttgattctgtttactaaatgtcacaacattgaatcttattctatatccccaccactctgaatcaaactattcccttttttagggctgaatttccagaagagtctcttaactggtctttgttatctactatgaaaccagtccaagtcattctctactttgttgccaaatcttatcacgtttctccctgcttaaaacttctcaataactaccagcacattgctcttaagatgaagaccaaaatccttaataggacatacagtgatgtgcgtgatcatcccctgctaacctcttctctgccttctcccttcccttattgtattccatccatgaagacttatcaatcccctcttttaagaggctccctcacgctgtcctccctctgtttatacacctcccactcctttcatctcactcttactcatccttcagatctgagtttaaatgtcatttcctcagagaagcaagaagttccttagtactgtgtatttctgcctaatttcacttaccacaattctaattgcacagtttgttggttattatctatccctgaagcaactctgattgctcttgaaaggcagggagtgcatttgctgtgtttaccacctatctccagcattaacacacaataaaaacaattggtgggacaaatgagtaaatgaattattaaattcactaatttgcttctttcatgctattgctctcaagtttaggaataaaattactatactcattacataaaagaaatatgaatttctaattttagggttttttattagttgaactttttactataagcaaaattgcttagcatttgaaatacctttttaaaaaatgttgcctagtctaccatctcatgtatgttgtaagttttatgtgattaaataagttttgatatgcagcaaaataacaacatgaaattgtaaattatactaatagtctgtgacttaattagcatgaaaaatcttcccatttatttataagaccaaataaaaatattaacttgagattagcactgcagctgttgaatatttcagtgctattaaatattggaggacataatttaaaaatgtacaaagatcatacacagatcgttttatagttttatttttcttactattatttagaaaaagacattttgaaatcagtgtttcccacaaagaaaaatacttaaatatgtaattttaatacatgcatatgccaaaattaatatttatttatttttgtttggatataagccaacatagacatgaatgtagctcttttctcctgagatagaagaacacactattgaaattcaatcagagcatccagatgtaaatgagctgttcatctatagcccacaggatgttcactttggcttcaatccttccagactggatccataccaagactttctattattactattaattagcagttctggcaaaattaaggaatattgttatgtcagcttgaaatcctttagactgactagtgatctcaaaaaaagttaagacttgatcgataattattccaagcatgatgattaaaaattaaattcctgatgtgatccatgattttttttccctctctcactctattttagaaaaacagggtaggtatttattagagaggaatctaaaatcagaggtagaaaagggcatggattttaaggtcttctctgtcttcatttagtcttccctttctttccacagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggaccagaaaatcttccacattatcctgtgttcaagtattaggattgtgcaatacatttcttagaagaattctgcctactactcatgcaaacaccaaacaggacaaatacaaaggcgaccacatctagacatgtcatattcaaactgctgaaaactaacaacaaaaaacaaatcttagaaggaaaagaaacctcgcatggggaaacaatgatctaaatgatagccaactttgcaggccagaagacagtgaaatgatacctttgcagtactgaatgaaagacaaagtcaacatagaattctatgtccaataaaaatatcctaaaaaagaaggcaaaataaaaacatttctagtaggcaaaagctgagagcactagtctttggtagatttgtactacacaaaatgccataaggaggttttcaggctgaagaaaaaaataccagttgcaacctaaatgaagcatgaagagtactagaaacagcgaagattaaagactattttaacatctttatttttaatacatatgtacctataaattttaacttcttcaaaaaattgactttttaagatataaataataacaatgtattgagctgcagcatatgtagaagtaaaatgtgggaaaataacagcacaaggaccagaagcatagatacatagaattatatatttaccaggttcttacattgtttgtgaagtaatataatattattttaatgtagattgggataacttaaaggtatatatctttaagatatcatatattctatatatcatatatatctttaagatatcatatattctatactgagcaatctataaaaaacaaagaagcatatctaaaaattcaatggatgagattaaattaaatactaaaaactactctattaacccaaaataagacaagaaaaaagggatgaaatgagagacaaattttgcaaatagaaaatcaatggtaggttataacccaatcatattaataattacactgaatataaatgaactaagcgctcaccccaaaaaaagtgattgtcagataggaaaaaagaaaaacctatctatatgctctttataagaaacatatttaagacagggtgcagtggctcgcgcctgtaatcccagcactttgggaggctgaggcaggcagatcacgaggtcaggagtttgagaccagcctggccaacatagtgaaaccacatctctatgaaaaatacaaaaattagccaggcatggtggtgcacgcctgtggtcccagctacttgggaggctgaggcagaagaatcacttgaacccaggaggcagaggttgcagtgaaccaagatcatgccactgccctccaatctgggcgacacagcgagactccatcttggggaaaaaaaaaaaaaaaagaaatgtatttaaataaagtgacacagtcagatcgaaagcaataggttggggaaaaaaaaccatgaaaaaatgaagtataagaaagctggtgtggttatataaatattagtcaaaggagatgtcaagacaaagattattaccagagatagagaactatatgcatgatgataaatggattgattcatcaagaaaacataacaatcttaactgtgcacctaatgacagagcataaaacaagaggtgatagataggacaaaaggagaaataggcaaattctcatttagttagtgtgatggtttggtttatatgtcaacttggctaagctacagtgcccagttatttaatcaaacaccaatttaggtgttgctttgaagatatgttgtccatgtggtgagatctacaatcagttgactgaaagtaaaggatattacttgatgatgtgggtgtgggttcacctaatcagttgaaaaccctagagtaaaaccaggtttcctggaacagaagatattctgcctcaagattgaagcactggctgggcgccgtggctcacgcctgtaatcccagtactttgggaggccgaggcgggctgatcacgaggtcaggagatcgagaccatcctggctaacatggtgaaaccccgtctctactaaaaatacaaaaaaattagccgggcgtagtggcgggtgcctgtagtcccagctactcgggaggctgaggcaggagaatggcgtgaaccccggggggcggagcttgcagtgagccgagatcgcaccactgcactccagcctgggcgacagagcgagactccgtctcaaaaagaaaaaaaaaaagattgaagcactaacacctacctgagtttccagcctgatggcctatcctattgatttcagactcgacagctcctaaaatcacatgagccaattcctttaaataattgtcttaatacatagatatgtatatcttctattgtgtctgtttctttggagaaccctgacttacatagtgctgttaacatcgctttgtctaagtagacaatataatcagtaaatatagaaaagatttgaacagcattattaaccaagttgatctaattaacaaatgcagatataaattatttcaagtactcatggaacattcataaagatcaacatgtgctgcatcaaaaaacacatctcaacaaatatcaaagattgaagtgatacatagtatattttgtgaccacaacagtattaaagtggaaattagtaataaatgtaagtagaaaatccccaacatttagaaattcagcaatatccttttaaataacccatgtgtcaaatgagaaattatgttggggattagaagattgtttgaactgattgataatagaaaacattataaatgggtgagatgcggctaaagaagtgcttacatggaaagttatagctttacatgcttatgtttaaaaagaagaaaggtttaccatcaatgacctacttctactttaaaaacctagactaaaaacttctctggtttccattgtaacatgtaaggagtttggaagtcattactgcatcctaacaacaaacaaaaagctgaaaagggcctggaaaataaaaacttgtctcagatctatcagagaagtgaggtcacagggcaaactactgtcctaaaaattagagagactgaatacagagaattacaacttaaaggagaagaaacccacaagcagaaacctccacaggaaccagtgctgggctatataaacctaaactctaattgacaaattcttagagccttagtgtagagaaatctaagagttaaaacaccatgggaacccagtcatatgggaacccacacaccttcatgagtttaccattcagagattgaccctattctcccagtagatattgaagaaaaatcctctcatgcttctgtcaggggaagggggaaagtaatcatttaaaagtataccagagcatgccattcttcttaacaaggcctgtcctcaggagaaactatttttaccagagcctaacctattggagtttttcagagcccaactgactgagggaaaggaaatattcaactctaccccactctagccatcctcttctacctaaaaggggagaaaagtgagaagcacatacaaacttcacagtccagaggcacaggctcactaaaacattgagtgctcatcacagtactaaagaaatctaccctgacccacactgtcccaccacatcactaaaggcctatttactgcaattccttttacccagtccatgttcacctttcaacaaagaaattataaagcatacttagaggcaaaatgtgcagtttgaaaaaagtaagcatcagacccagagttggatatagcaggatgttgcagttaccagattaggaattttaaaaaattatgattgatgtgttaaggactctactggacaaaatagagaacatgtaagaatggatgcatgatgtaagcagagtgatggaaattctaagacagaataaaaaagaaatactaaaaaaagaaatgctagagataaataaccctgtaacagaaatgaagaatgactttggtgagctcattagtggactggagatagccgagaaaaaaaactgtgagcttgaggatatgtcagtagaaactttcaaaactgaaaagcaaagagtaaaataccaaaaacaatgaaatggaatatctaagaaatgtgataaaactacaaaaggtgtgaatacatgtaacggaaatatcaagaggagaaagagcaaacagaagcaataattgaagcaataaggacacagttttccccaaattcctgacagatatcaaaccgcagatcccggaagcagagagaataccaagcaggataaatgcaaaaaacaaacaaacaaacaaaaaatacccaaaccaaaaaaaagcctatacctaggcatatcatattcaaattacagaaatcaaagacaaattcttgaaagaagtcataggaaaaaaataccttatctttagagaatcaaaagtaagaattacatccaattttctccaggaatgcatgcaagcatgaagagagtagagtaaattatttatggtgtgtattagttcatttcatgctgctgataaagacacacccaagactgggtaatttataaagaaaaataggtttaattgactcacattctatgtggctagggaggcctcacagtgatggtgggaggcaaaagtcatgtcttacatgcagcagagaagagaaaatgagagccaagtgaaagggtttccccttataaaaccatcagatcttgtgagacttactcactaccatgagaacagtatggggaaaactgtgtccatgattcagttacctcctatagggtccctcccatgacacatggggaattatgacagctacaattgaagatatgagatttgggtggggacacagccaaatcatataattctgcccctggctcatcccaaatctcatgttctcacatttcaaaaccaatcatgcctcctcaatggtcccctaaagtcttaactcatttcagcattaactcaaaagtctcatctgacacaaggcaagtcccttctgcctatgagcctgtaaaatcaaaagtaagttcgttacttcctagatacaatgagggtacaggcattagatagatacacccattccaaatagaagaaataggccaaaatgaaggggccaaaggccccatgcaagtctgaaatccaacaggacagtcaaattttaaagctccaaaatgatctcctttgacttcatgtctcacatccaggtcagactgatgcaagatgtgggttcccatggtctttggaagctctgcccccatagctctacagggtacaggctccctcccagctgctttcacaggttggtgttgagtgtctgtggcttctccaggcacatggtgcaagctgtcagtggatctaccattctggggtctggaggacagtggccctcttctcacagcttccttaagcagtgccccactggggactctgtgggggcttcaaccccacattttccttctgcacttccctagcagaggttcttcatgagggatcatccctgcagggaacttcttcctggacatccaggagtttccatacatcctctaaaatctaaccggaggttcccaaacctcaattcttgacttctgtgcacccgcaggctcaacaccatgtggaagctgccagggcttggggctttcaccctctgaagccacgacctgaaccataccttgaccccttttaaccacggctggaatggctgggacacagggcaccaagtccctaggatgtacacagaagaggggccctgggctccacccgcaaaaccattttttcctcctaagactctagacctatgatgggagggtctgctgcaaaggtctctgacatgccctggagacattttccctattgtcttggtgattaacatttgactcattattacttatgtgaatttttgcagctggcttgaatttctcctcagaaaatgggattttctttcctattgcattgtcagtcctccaaactattccaacttctgtctgttacccaattccaaggtcacttctgcatttttgggtatcttttcaggagcatcccactctactggtaccaatttgctgtattagtctgttctcatgctgctgataaagacatacccaagactgggcaatttataaaagaaagaggtttaatgaacttacagttccatgtgcctggggaagcctcacaatcatggtggaaggcaaggaggagcaagtcacctcttacatggatggcagtaggcaaaagagagagcttgtgcagggaaactccccttataatatggtcagatcttgtgagacttattcactattatgggaacagcacaggaaagacctgcccccattattcaattacctcccaccatatccctcccacaacatatggaattcaagatgagatttgggttgagacacagccaaactatatcagtgcattaaggattgtcatgtctttatggggtattgacccttttatcattttgttatgtccctctttatccctgataactttccttgttccgaaatttgctttgtatggaattacatagctactcctgctttcttttgattggtgttagcataattatcttcactcgttttcttttaatctatatgtgtctttatatttaagatgagttttttgtagacaacaatagtttggccttcttttttgatccactttgatatatatattttaatcagtgtatttagaccattgagttttaaaatgattgtcaatggatctggactcatatctaccatatttgttaatgttttctattcatttaccttgttcttattttgtcttcttttctgtttctgccttttgtggttttaagtgagcattttatatgatttcattttctctcctttcttagcataacacttgtacttctttttgtactttttaaagtgattctcttagtttgtaatatacatttacaactaatccaagtccaatttcaaataacactttaccacttcatattattaccagtactttgtaataaaatattccaaacttctctctcccataccttatattattgttgtcatttattttacttatacataagcatacataagtatcataagcttaaatatatctatatctatacatatgtacccacataagcatacataataaaatatatagattttttaagcaaactactatgttagatcaattaagaataagaaaaaataaaagtttgcattttacttccacttatttcttcttgatgctgtttttctcttttcatagatgagagtttctgaactatatcatcttcttctctctgaagaacttctcttaatgtttttgcaaggcactcctagcaacaaatgcactccatttttgtttgctgagaaagtcttgatttctctttcacattttcttttcttttaattcttcacttttgaaagataatttcacaaggtacagaattataggtggtggtggggtttctcttaacatcatgatatgatttggttgtgtccccacccaaatcttatcttgaattgtagctccatgagcggggctctcatgaagaatctatgctagggcagtgaggaagggaaatgtggggttgaagcccccacacagagttcctcctggggcaccacctagtgtagctgtgagaagagggccaccgtccagaccccagaatggtagatccaccaacggcttgcaccatgtgtctggaaaagccacagacattcaacaccagaccatgaaagcagctgggagggaggctgtaccctgcaaagccacaggggcagagctgcccaagaccatgggaacccacctcttgcatcaatgtgacctagatatgagccatggagtcaaaggagatcattttggagctctaagatttgaccaccccgctggattttggacctgcatggggcctgtagcccctttgttttagcccatttctcccatttggaatggctgtatttacccaatgcttatacctccattgtatctaaaaagtaactaacatgcttttgattttacaggctcataggcagaagggacttgccttgtctcagatgagacattgcactgtggacttctgagttaatactgaagtgagttaagactttgggggactgttgggaaggcattactggttttcaaatgtgaggacatgagatttgggaggggccaagggtggaatgatatggtttggctctgtgtcgccacccaaatctcatcttgaattcccacatgttgtgagagggacccagtgggaggtaattgaatcatgggggcaggtcttccccatgctgttctcgtgatagtgaataagtctcacaagatctgatgatattataaggggagtttccctgcacaagctttctctttttgcctgctgccatccatgtaagatgtgacttgctcctccttgccttctaccatgattgtgaggcttcctcagccgtgtggaactgtaagtccattaaacctctttcttctgtaaattgcccagtctcaggtctgtctttatcagtagtgttagagcagtctaatacgtgcacataaaaacagagtgtcaaaatatgtaagcaaaaactgatacaagtgcaaggagaaatagttaaatccagtattattattggagattttaacacacccctctattagaaatggacaggtccagtaggcaagaagatcagtaacaacagagttgaactcaacaacaccatcaatcaactggttataatggatatctattgactacttcatctaacaacagcagaatacacattcttccaagcttacatggaacattcaccagtatagaacatattctgggccaaaaaacacataccttaacaaatttgaaggaataggaatcatacaatcaatgtcttctctcagactgcaataaaattaaactagaaatcaaaaacaggtagttggaaaatccccacatacttagagattaaacaacatacttctaagtaacacataggtcaaagaagaaatctcaagataaaattttaaatactttgaactaaatgaaaatgaaaacacaacttatgaaaacttgtgggatgcagcaaacatctcacaagtttttaaaatgcgtaaagggaaatatacacagtagtacttcctcatttgcagttttactttttgtggtttcagttatctgtggtcaactacagtctgaaaatattaagtgaaaaattccaaaaataaacaattcttaagttttaaattgaatactgttctgagtagcatgataaaatctcttgccttcccacttcatcccctatgagatgtaaatcctcctttgttcaccttatatacattcactacctggccattagtcatttagtagcagtcttttttttttttgagacagggtctcactctgtcacacaggctggagtgcagtggcactgtcttggcttactgcaacctctacctcctgtgttcaagtaattctcctgcctcagctctgcccccctccccccagccccccaccgtccctgagtagctgggattacaggcaggccaccatgcctggctaactttcgtattttttggcagaggcggggtttcaccatgtgagccaggctggtctcgaatttctggcctcaagtgatctgcctacctcagcctcctggagtgttgggaatacaggcgtgagcagtcttggttattagattgactattgtgatatgaccgtgcttgtgttcaagtaacccttattttacttaatggctccaaagcacaaaagtagaaatgctggcaattcagatatgaaggaagccataaagtacttcctttaagtgaaaaggtgaacattcttgacttaataagaaaagaaaaaaattatatgctgaacttgctaacatctacggtaaaaatgaatcttctatccacgatattgtgaagaaggataaaaaaattcatgctagttttgttgtcacacctcatgctgcaaaagtatggccactgtaagtgcctagttaagatgaaaaaagcgttacattttgtggctggaagacagaaatagaaacatattctgatttacagcatttaggctgggtactatccaaggtttcaggcatccactggaagtcttggaacatagcgcctgtggataaggggaaactactgtagtattgaatgcatatattaggaaagcagaaagatctaaaatcaatcatgcaagcttttaccatagaaaactagagaaagggcaaattaatccaaagtaagcacaagaaacaataaatattagagtagaaattaaagaaattgaaataggaaatcaatagggaaaatttttgaaaccaaaagctgggtctttgaaaagataacaaaactgataagcttctagccaggctaggaaaaagaagggcacaaattactacttttggaaggaggagatttcacttcagagcccatggacattggaaggataataaaggaatactatgaataattctgtgcccacaaatttgataacctaggggaaatagatgaatttcttgaaaaataaaatctgataaaactcacacaagaagaaatagacaatccagataggcctagatctattaaaggaatggaattaataattaataaccttccaaaacagaaaccatgagaccctgatcagttcactagtaaattctaccaaatacttaaggaacaaattatatcaattctctacagtcttttctaaaatatagaggcatatggaatatttactaactcattctatgaggccagcttcaccataatgtcaaaatcagacaaaaacattatgagaaaagatcaatatttcttatgaatatagacacaaaagtcctcaacaaaatattagcagactgaatcaagcaatgtataaaaataattatattccatgactaagtgggatttatcccaggtatgcaaggttggctcaaatttgaaaatcaattactgcaatccatcacatctacagactaaggaagaaaaatgacatggttatatcaagagatgcagaaaaagcatttgtcaaaatacaacacctatttgtaataaaaactcagctagaattttagaggggaactccctcatcctgataaagaacatctacaaaacccctacaactaacataagacttaatggcaagaaactaaaagcttttctactcagatcaggaacaagacaaggatgttccttctcaccacttcttacattttactggaaatcctagctaacacaataagacatgaaaaggaaataaaagatatattgatcgagaagaaataaataaaacagtctttgttcatggataatatgattgtcgaggtaaaaaatctgaagaaatcaacaaaacaattcctggaactgatatgtgattatagcaagattgcaggatacaaggttaatgtacaaaatttaatgtcttttccatatgccagaaatgaaaaagtggaatttgaaattaaagacaaaaatcctttcagattagtgcatccccaaaatgaaatagttaagtacacatccaacaaaatatgtacaagatctatatgaaaaaaaactacataactctgatggaaaaaaaaatcaaggaactaaataaatggagagaaggccaggtgtgatgtctcacatctgtaatcccagcactttgggaggctgaggcaggtgcatcacatgatgtcaggagttcaaggccaacatgaccaacatggcgaaaccccgtctctactgaaaatacaaaaattagctgggcatggtggtgtgcacctgtaatccaagctactcgggaggctgagacacgagaatagcttgaacccgggaggtggaggttgcagtgagtcgagatcgcaccattgcactccagcctgggtgacagagcgagactccatcaaaaaaaaaaaaaaaagagataaattaagagatatttcatgtccatgcaaggaagagtcaatattgttaagatgtcatttcctcccacattgatctacagattcaatgaaattccaattaaaatcctgacaagttattttgcaggtatcaacaaacagattccaaagtttctgtggagaggcaaataacctgaaatagacaacaaaatattgagtgaagttggagtactgacattattcaactaggttacaaatgaaatgggaaaacagtttcatagttggctttgttctatagtttacattagggttaactctaagtgttgtacattctgtgggttttggaaaatgcataatatgctgttttggtgaaaccaaaagcagtaagtgagcaatatatgccttagcaatctatctttattaattcacatatttagagctgacttattcatataaagctttgcttcttataagaaataactggctttctctttaaaataagctgaagctgtgtgagattgtataaaacattatatattgactaatagggaaaaactttcttgtgtatacaggattttgtaattaaggttgaaaatgtaatctttaaacctgaaaggcttaaaaaaatttttagcccccacatgtaaagtgaaaatgtgatgtttgtctttctgtgcctgctttatttcattcagcatgagttccatcatgctcattcatgctgcctcaaatgacaagattttattatttttatgcctaaatattattcaattgtgtatatataccacattttctttatccattcatcctttgatagacagttaggatgattttatatcttggctattgtgaatagtgctccaataaacatgagagtgcaaatatttctttgacatactgatttcatttcctttggacacatacccagtagtggggttgcttgatcatatggtatttctatttggagttttttgaggaaacatcacactgttttttataatggctgtactaatttgcattcttatcaacagtgtaagagttcccttttctttgcatcccacttgcgtttgttattatttgtctttttcatatgaataatagccattttaactggggtgagataatatcttattgtggttttgataggcattttccttatgattagtgatgttgatcgttttttattatacctgttggccatttgtatgtcttcttttgagaaatgttcatccaggtcctttgcccactttttgatcaggtcatttgttttcttgctactgagttgagttccttaaatattttagatatcaaccccatatcagacatatagtttgataatattttctcccattctatagattgtctctttattctgttgattgtttccttctccgtgcagaaaatttttagtttggtataatcccgtttgtctatttttgcttctgttgcctgtgcttttgaggtcttacccaagaaatgcttgcccagaccaatgtcctgaagcctttccccagtgttttttctagtagtttcacagcttcaggtcttacatttaagtctttaatccattttgattttatttttatatattatgagagaaagaaatctgatttcaaatttctgatttcttttgcatttagatatctagttttacagcaccatttattgatgagactgttctttcccttatatattcttggtgcctttgttaaacatgatttggttgtacatgtctggatttacttctgagttctctattctttttcattggtctatgtgtctgtttttgtgtcagtaccatgctgttttggttactatagctttgtagtatattttgaagtcataaagcctatgcaactattatcaatctgggcacatggatggcattcaatatacattttttctttcttaagagtcattcaatcatcaaaatttgggaagtttttggtaaatataggactttaacttttgtgaaagttaaaaaagcaaaagaagatcttcccccaaataagaaaggatctagtgttggagagaacagaaacacagctgaaaatattcatgaaaagatgtggaacgtaagctcagggtcaaccaaggatattaatcagactattaaatgtattctcttctaattagatctgaagtgtgtttaccctgcttaaaaaagtggaccagctgataagtaccaaacaattctggagcgatataaagagaggcatcacccaaagaaggtcatgagttcactggaaaaatgaagtaacactgttgtcatgagtggccacagtaatagccagaagagattgaatgtgccttaagtttaaggataaaaatgtaattgtgatgggaggttggagaggaagctaggcctgtagccaaagtatggaaaaaaaaaaaaaaggaaatacagacaaaggtagcaatagagttgggtgatttaggaagctaggtctgtgaacaaagggaatgtaccaggttcctcccttcatgcggtgcccagggaacactttccagggctcaagtgccctctaaaggcatcactctgccaggttggactcagagccaaatgtaattgtgctgctctcttccattcaagtaggtgcctttgtttaacataagtgaccacttttaaagagctcagtcttcttggttccactcttgaactttcagtgttatcaacaaaaacctgttttgttttcgcattttcccctcagtgccttagcatggtgtcccaaacacttcttgatgatttttaatacttggattatacacataatgcccttctcaatctcccttttacttcccctcaaataaaataaaaaatttaagatactgcattcctgagtccaaggattgttacagttgtcacccccaaaattaggacaataatcacacaaattacaattcttctattcagaacataaatctgatattcttgagctcatttgataaatattaagtatcctcatatggtttctggtttacatacatttgccatgtataatatccataagccattctgggtgtgtgtccctattttataatctctagttgggagggagagcaccaagcctttaaattacgatctcatgcagaataacagctcagggtcaaccaaggataatgatcagaccattaaatatgttctctactgttcggatctgaagtgtgttgaccctcttaaaatagtggaccagatgataagtaccaaacacttctggagggatataaagagaggcatcacccaaagaaggtcatgagttcactagaaaaatgaagtaaaacttattcatttcatgtcagctgctaaaggatgtgctgcagggtgtagggtgtggcttaactgattacccattacggtgatcctaatagttttcatcaatgagaatattgtcaccgaatcttagcatttttgaaatgaaatgttgtggctctattatgtagttctttttgccagtctctgaaatcagttttttaaataacttacctctaaactctcgctctgcatttccttttgtttcctggatgtgaatgtggattcattggtagatgttaggcaaaggctaacttatcagtcatttctaggctcttcaaggtgaagcaatgcccacagacagtcttagaagggaattctgttctctcctttccttatttattcaaagactttcagattgtatttcactattactagagaattctttagtaaagctggatggattcttcaatgcattgggaacattcattcatggaaattggctctattgcagtgtttctcagacttgtgtatgcatacgagtcccctggggatcttgtgaacatgcaggttctatcctgtaggtcatttaatttcactgaatttgtgcaatgcaaaaagtccctttctgaacctgaatccacagataccagcataacctggagcctgttagaaaggcagactttcggatcctactccagatccatagaatcagaatctgcgttttaacaagattccagagggaattcatttgtacaaaatttgggaaacatcatcctgaaaatcacgtaggatcagctatgtaatggcaaaagcaaaagcaaacttatggtaccttctcttttttatgttattctctgattattccctgaggatgcagctgcatataatacggaatcattcatgtaaagagaagcaacctgtccaaaataccttcctttttgtattgaatcttgaaacagtgatgtcatttcctataatataccacatactaacagttgcaaattggtatctgagggctgtgtctagacagaagatatgttttgttggttattttgtttgtcctgtggatgattaaaaggcaatgttattgggcaggtgtgagcagttagcagctattttttcacatggagaagataatacagaggtgttatgcatagtatctataggcatttgagtctggaatccttaagagtaataattcccaacataaattccatggaacagtaatgtaagaatgattaacaggtattatttgaaaaaataaaaaaagtttctgtgatgcgttggcatgataaacagtgaaacaaaagaaatttggggggaggatattacagaggctttatatcataatatgcagtttgaacctccactgcaacatttctcaagcttatttactcaggaaattctgtgtctcaaatgattagagttctatagaacatactttagaacaggagtcagcaaactatagcctgcagactaaatccaacctgccacctgtttttgtactgcctacaagctaagaacagtctttatgtatttacatgtttaaaaccaaaagaagaagaatatttcattacacatgagaattctgtaaaatccaaatatcggtgcttataagtcaagtttttttggaacacaatcacactccttggtttacattttgcctttggcagcgatcatactataagggcagagttggcagctgagacagtgatcacatggcctgtaaagctgaaaatatctattatctgaccctttaaaaaaaagtttgccaacacctactttagagcacactgcgattcgattaccgcaactttttttttttttttttgagacagagtttccgctcttgttgcccaggttggagtgcaatggcacgatctcagctcactgaaacctccacctcccaggttcaagcgattctcctgcctcagcctcctgagtagctggaattacaggcacccgccaccacaccctgcttatttttgtattttcagtagagacgggatttcaccacgttggccaggctggtctcgaactcatgacctcaggtaatccacctgcctcagcctcctaaagtgctgagattacaggcgtgagccaccgtgcctggcctgcaattacttttgcaccaaccaaataaaaaggcctggcttcctcaaatgggaaatgataatgataacatagtgtcttttttgatgagtataagtgtactaacgataacattgtgtagcaaataaatattttctcttgtagacactttgaaatcaatgtaaaatcatatcaaatattcattttactacattataataagaattcctttctggggattaccactgttttcagacttttaagaaatagagtttagatttgataacaaatttttgcaattttcagttattacaacatgtgcctaagtatattttaagctgattaatcttttcaaactttttagtctcaggagccctttacactcttaaaaattattaagggcctcaaagaaattttatttttataggttatatctatcaatatttcagaaattaaaattgagagaatttaaaaaagtattacgcattttaaaataataataaaccattttatataaatatcaataacatatctcttgtgaaaataactatatttttcaaagagtggcatttttgaaaaaatctcattaacatctagtttgataggagatagctaaattctcatattacttctttatttaactgttgtgctattacacctcattaggcccctggaaaactccactcattctttgtgaaagaataaaagtgatctcaaaaaattttttaaaaataaatcgcatcaagtatcttatctgaccacaatgaaaaaaacctagaaataaataataagaggaccatgggacatttggaactgtgcaaatacatgtaaatgaaacaaaaagcacctgtccaaccaatgagtgaaggaagaaattaagaaggaaatgtaaacattccttgaaacaaacgaaaatagaaacacaacataccaaaacctatggggcacagcaaacatagtattaagaggcaagtttatagcaataaatttttacataaaaaagaaagatttcaagtaaacaacctaatgatatacctcaaggaattagaaaagcaagaacaaactaaattcaaaattagcagaaaaaaagaaataatgaagttcagagcataaataaaatcgagactaaccaaatagaaaaaaactcagtgaaacaaaaagttgctttatgaaaagataaacaaaattgacaaactattagctagactaagaaaagagagaagacccaaataaataaatgaaatcagatctgaaaaaaatgacatcacaactgatgccacagaaatacaaacgatcattagaaactattatgaataactatataccactaaatttgaaaagagggagaaaatgaataaatttctggacacatacaacctaccaagattgaaccaagaagacagagaaaacttaaacttacccataatgggtaacaagattgaatccataataaaaagtctcccaataaagacacgcccagaaccagagagcttcaatgctgtctaccaaacttttaaagaacaaataccaattgttctcaaactattccaaaaatttgaagtggagagaattcttccaaactcattctatgaggtcagcataaccatgataccaaaaccagatgaggacacaacaaaacaagaaaactacagaccaatacccctgatgaatatacatgtaaaaatcctcaacaacagactagcaaactgaatcaaacagcacacaaaaatttcaaacaccgtgatgtagtaggatttatcccagggatgcaaggatggttcaacatacacaaatcaataaacatgatccattacaataatagaatgaggaacaaaaaccatatatcatctcattagatgccaaaagagcatttaataaaattcaacatttcttcatgataaaaactctcaataaactaggtaatagaaggaaaatacctcaatacaatcaaggccatatgtgacaaacccatagctaacaacatactggacagggaacaactggaacaagacaagccactcttaccactcttattcagtatagcactagaagtcctagccagaacaattaggcaagagacagaatttaagggcatccagattggaaaggaagaagtcatattgcctgtgtttgcagatgccatgatcttatatatagaaaatcctaaaggctgtaccaaaaaactcttagaattgataaacaaattcagtaaagttgcagggtacaaaatcaacatgtaaaaatcagtagtgtttcacacataaactagctgacaaacaaatgaagagagtaatttcatttccaattgctacaaatacaaattacccaggaacaaatttaaccaaagaggtgaaagatttcacaaggaaaactataaaacacagatgaaagaaattaaagaagtgcactcaaaaaaggaaagacatcccaaatcatcccaaattcatagactggaaaaattaatatgttaaaatgaccatactatccaaagtgatctatatatttaatgcaatccctatcaaaataccaatgatagtcttcaaagaaatagaaaaaaaatcttaacatttgtatggaaccacaaaataccctgaatagccatagcaatcctaagcaaaaataacaaagctgaaggcatcacattaccagacttcaaaatatactataaagctatagtaaccaaagcaacatagtactggcattaaaaacagacacatagaccaatgaaacagaacccagaaccctgaaattaattgacatatacaaagccaactgatttttgacaaaggtgcaaagaacattcattgggaaaaagacactctttcaataaatggtgctggaaaaactggatatccatatgcagaagaataaaatcagatccccgtctctcactatatacaaaaaccaactcaaaatgggttaagagctaaatgtaaaacttgaaactatacaactgctagaagaaaacaggggaaatgcttcaggatgcttgtctgggaaaatattttgtgaataagacctttaaagcacaagggacaaaagcaaaagtaaacaaatggaattgtctcaaactaaaaaccttctgcacagcaaagtaaacaatcaacagagtgaaagagacaaccaacagaatgggagaatattttttcaaactattcatctcacaggagattgaaattcagaatatgcaagaaactcaaagatctcaatggcaaacaaaaaacctccaatcaaaacatgggcaaactatctgaatagataattttcaaaagaagatagacaaatgaccaacacatacatgaaaaagtattcaacatcactaatcatcagggaaacaaaactagaactacgatgagatatcatctcatcccaagtaagatgactgttatcaaaaagacaaaaaatgacaaatgccagccaggatgtggaggaaagggatttcttacacactgttggtgggaatgtaaactagtacagccactacggagaacagtatggaggttcttctaataaatcaaaataggactactatatgattcagcaagcccacaactgggtacttattgaaaggaaagacaattattatattgaaaagacttctgcaccatcatgtttattgtagcactattcacaatagccaagatataaagtcaatccaagtgtccaacaacagatgaataaattaagaaaatgtggtatatacacaatggaatactattcagcctttaaaaagaataaaatcttgtcatgcatggcaacatggctggaactgaaggacatcatattaagtgaaataggccagaaacagaaagttaaacatcacatgatctcatttctatatgggaacaacaaaaaaagttcttggaagtaaaaagtagaagagaggttactagaagctgggaagtgtaggggaaaaggggagatgagaagagatttgttaaagtatacaaaattacagctagaaagaaggaataagttttaatgtttgatagcactgtggaatgactataattaaccataatatatatttagaagtagctagaagagagaatattaaatgtttccaacacaaagaagtgataaatgtttgagatgatggatatgctaattgccctgatctgatcactaaacattgtatatatcaaaacatcaatatgtgccccacgaatatgtacaattcttatgtgtcaattaaaaacataaattaattaaaaaattaaaaaaactagttagtgttgagaaggatgtagaccatatgtaattttcacacattgatggtggaaatacaaaatggaacagttattttggaatacagtttagcagttctttataaagtcaaacatatatttaccatatgccccagtcatccatcttctaggtattcatccaagataaatgaaagcatatttttgtacaacagtttgttccagaagcttcattctagccacaaactggaaacaactcaaatgtcttatagaagataaatggataaacaaactgtggtaaatccatacaatggaatactattcagtaacaaaaaaagaacaaaatactgatacacataacaacatggataaatttcatttctgttaagtgaaagaagccagacgtaaaagatacgtactgtataattcttttatgtgaaattctagaaagcgtgtaagtatagtgagagaaagcaggtctgtggatgctcacagccaggaaagaaggggttacctataaagggcacaaatgaactttggggggtgatggaaatatcctataccttggtcgttgtggtgattgcacagctacatacattgatcaaaactcaccagacgtatacctaaagttggtcaactttagcctatataaattgtacctcagtaaagctgatattaaaaatcaatcacatggctatacagcagtgtgaatgtacttgatgccactgaactgtacaattaaaatgaataaaatggtaagttttatgtcatgtatattttatctcaattaaaatacatggataatatccctccctaaaaatgagagtgaaaaaggcaaataatgtcttagaattgttatgggccctctgaaggtgtgtcaggggcccccagggttccctgtaccacactttgaaaagtgttactcttttgtaactaagaatgaataatcatatacatcacacacacacacacacacacacacacacacacgtgcacactcatacacacgtttatactggtaaaaattatcaacaatcttcaatttaggaatgaagtgtttcaattgtttgcttataagtatcctgtttgcttgttgagcccaattgacttgtactaatagtatttcagaacccatctgtttaggtatttgtgattctgtgtataaatatagagagagtccaacctgggtgacaggaacatgactcccttcttgctgactagtaatggtgctggaacctctatccccgcatcactccttacctgttagtgaaatttgggatttcttcagccccaagctactactggggttcccctggccagggttggaggtaagaacctgatgaaaatagggacttgggatatgagtaggtaggtgtgaaaaacttttcttttatgaaatgcagggattagtgcaacatttttttcaccctcttgcttctgtgttttggatcaagtcctgtcttgttctctcctgtttccccatatcctcctatatttgttagacctcttacaattcaaactagcttacttaaagacaagataatttgttggttcacattccttgaaaagtccaggtataaaaggtagaggagctaacttcagacacgtttagatgtcatcaggacgttttctctctgtgtctctaaactctacttctctgtgttggcatcatttctagttaaactggtcctttccgtgtggtgaaaaataaggctaactgaatgcatagtcatcgtggaaggaaagaaacctgcttttttaccagtgattaaatcagtcccagattaaatgatgccagctggccaaccagggtcacaagccagtttcttagtggaaaaaggaagtccttgactggaaacccctccagaatacatggaaaggtgtaggagaattggagaagggattcaggggagacagcaagggaaaaatttgtcctgcaattcttgtttctaagtgaaatcaaggaccttttgaagttttctgaatgtctttgcaatttttaaattttcattgacaatttgaattaatttgctataataattaattgctttgaaggaaactgagaaatagattccaaactgtagataagatacagacttttagaaatgtcactcttcaactaacctagtattcttcaaccccagctaatcatggctgcatgctccttagcttcatgatcaatgtatgtagctgtctgtttctgtcttgatcatttctgaagctgctgtttccttatgttttctcaacacagaggctaccatgccttttttattgagggggaagctgagacttagtgaagtcaaataatttgtccaaggtctccattagtaagtgacattatagaactgaatccttttcaccccaagctaattttctttccaccataggctctaccttccaattaaacctcttgctagccaaatatgttctaaatttgtttattcattttccaaatatttattgacaggcactcttctggacactgagggaggatacacaatgaagaaaatagacaagttcttgttctcatggtgtgaataccctagcggaagggcagaaaataagcaaataaatatatatgatgtcacatggcaacactactggcaagaagaggattggaaaagtgtgctttttaattaggatgattaaagatgacgtctttgaggttacggttgaccagagccctcattgaagccaggaagcatggcagggagatagtgaaggaagggcatcccagacaggagaactggaggacaaaggctctgggtgtgaaagtctttggcatatttacagggaataggatagaggtggggggacctggaactgttaaggggttggggtggaagcagcaggagattaaatcagagaggtagccagaggaggttttatccagagagaccagagagatggcaaatattcaactgtgtgttctcattctctggaagaagaaaacactttatcattttacagtgcttaccttgagaatatgaaaaaagagaatcttttatcatttcagtcatctataagtgagtattcaaatttatatgttcaatcatttagtagttcattcttacagtcaacatttactaggcacccactgtaccctagatactccgccagatgttagagctatgaaaaaggaaaagagataccattttctatcctccagaaccagatgtgagtatgttgtatacaactggaggatgatcaggttgacaagagcatcttgtattactgtccacacattttttaccccccaaaatgtgtggtttccacaagaactagctggaagcctgccatttactgacacattgctacaaatttttaaattaaatgttttactagaaatggattcaatgtggtaacggatctgtctgactacgtttcagaagggtttaaaagcatttaatttccatgtcacatccattaaaagttaatgatgtcatgcactccagggagcaatccatttcataatttaaagtggaaccaacaaaacacgactcaaaagggaaatgaaggtgacaaggtacagaataacatgaaccagtgtagctgcacctgtcatgacccttcccggggttaacctggcagagaacagagagtttaagggaaatgaatcagagaaccaagccacattccatcttcctcagagagaaaagagcataaatcaggaagaaataaagtttatgtgatatgcagcacacatttttagcgttggtttccttcacactgaaatgaggaaaacagagcataaggaaagccacgtgaggggactgcataatgagctgtgggattccagaggatgtagatctccacgaaccctctgactccacacttgaactgtgaggccaactggcaccctccctccgtctccacactgcctgaggctctttcctgtgcctgcgcttctgaacaacagaggaaacccagggatacgctcttcccaatactcactcccctgcccttccagctccttccaccttgtttacatttgtactcgcgtatttcatgtgggttgtgaaagctggtaacgttatggctacagagtgctctattatattttcaagggcggaaaaaggctgtatgtgaagctgccaaatcaaatccttgccaaaatggtccaagctaatgagaaggtttgtaaattacagttcaatggatgagacgtggaggacaaggaatatcatgcccacccagcaaatagaatcactgagcatcactagcttttttactggtatatatatatatatatattatatatataatatatattatatatataatatatatatcttttttgcactatatatattttgcactatatatatactgcaaaatacatatatacatattttgcactatatatagtgcaaaaaatatatatacatattttgcactatatatatagtgcaaaaaatatatatacatatttttgcatgatcttagtcaaagtattcaaaaatttaagcatttatagagtaaagtttcatcaattcctatacatttaagctggaactagatcgggtgttacttaaactgacaactaatgcaatgttttatataatacagatgatcaataaatttctgcttaatgaaagaataggtgtctacaaaaataaatagacacatttagattgcagaaccaataattaagggcaactttaccatttgagtctacttcctgccccacttcctccccacagtaaagtttagaattttccacatattctgatatgatttaattttaactagtcctatcacttatcagctcatttctagactgattaatggacatcgaccaattttaatttataaattggtcttttccctgtttctttagattttggaagttttgtgtgcatttgctttggagccaaacacgagaagaaattttaaaaatcacagctctttgagtctttaaacatttttcaagttataaagtcatttagtttcagagacttttccattttctagctgaaagcaatcaactttaagaatccctatataagaattcctagaagtgcctggtcagaaaattaaagcagaggaagaattgatttctttgttatagtttccataatcatttaatcagaaacaatacaaaaaattaatccatttcttaaaatgtttacatgacactttctatgcatattcattaaaaagtataaaatatttttgtaatggatcaaaatttaacaaaatttaatttattttattaaactaagttttttctttaataaaaacaatcatgataattaagaaaatagaaagcattcaagttaaaataaagccagtaatattccacactatcaagcttaaaacatcattatgaaaattttgaagacgttaattttagatgtagggaatggtaattgcttgggctttgcctgcacatcagtagcaatgatagtcagatacaaatttagactttaacttaattcctcttttcctgcaggtcctttctcctgtataattatactcaatcattaaaaagaaatgaactcaatatcttaatatacatggaattactctgttgtatctacaagaagcacatttcctattttcaataagttgagttgaaaagaaaagaatgcaactttttgaattattttgtaaaatgcagttagtaaaagctttagtgttgctttttgtctttaatttgttttgttagttgtttctttctgtggtattcactatgatgcattttgtgttgctggaagctagtggtaacaatgcaatagacaaaaatacaggggagtaaagaatgaagggaacagaagaaaaaaaggaactatgagacttttcatgtgacatgttctagagctcagtacagagtactgtggagtttggttttaggtggagttacctctgcctattggagtcaggaatggcatccacataaaaaaaatgtatctgaaaaatgtccaaagcaatctacagattcagtgaaatacctatcaaaatcccaattttctgtttttacagaaaaagaaaaaaacaatttcaaaactcatatgggaccactgatgaccaccaatagctaaagcaatcccaagaaagaaggacaaagttggaggcctcacacttcttgatttcaaattacattacaacgctgcagtaattaagagtatatactatcataaagatggacatactgcccagtggaacagaatggagaacccagaaataaattcacacatatatggtcaactgatctttgacaagggtgccaagaatacacaacggagaaaggcttttctcttcaacaaatggtactgggaaacacacaaaagaatgaaattgtacctttctattatatacaaaatcaaatcaaatatattagaaacttaaacctaagacccaaaactgtaaaactccaagaaaaacatagggaaaaactttatgactttgtcttggcaatgacttcatggatataacacgaaaaacactatcaacaaaaacaaaaacaacatgagactacatcaaactaaaaagctcctgtgcagcaaaggaaacaatcaacggagtgaaaaggcaattgatgaaatgaaagaaatatccatgaaccatctatctgataaaggactaatctccaaaatatataaggaacttctataattcaatagcaaaaaaaccacatgacctgatttaaaaatgagctaaggttttgaatagacatttctccaaagaagatacaaatggccaacaaatataagaaaaaatgctcaatgttacaaatcatttggaaaatgcaaataaaaaccaccatgagattttacttcacacctgtccagatggatatcatcaaaaaaaaaaaaaggacaaaatgtactgatgaggatgtggagaaataggaacgctggcacactgttggtggaaatgcaaaatagtgaagctgctacagaaaatactatgaagattcctcaaaaaattaaaaatagaacttccatatatatgattcagctattccacttctggatatttatcaaaagagttgaaaccaggatcttaaagagatatcagcagcactattcgcaatagtcaagatgcagaaataacctaaatgtccattgacagatgaatagatacagaatatgcgatatatacattgaaatattatcagccttaaaaaggaaggacattctataatatgcaatgacatgatgaacctggaggacatcaagctaagtgaaataagccagtcacagaaagaccaatactgcattattccacttatatgaagtatccaaaatagtcagattcatagaatcaaagaatgaaatggtgtttgccagggaatagcaggaggggggaatagagagttatgaatcaacaggcataaggctccagtcaagcaagatgaatgagctctagagatttgctgtacaacattgtacctagagtcaacaatactgtattgtctgtttaaaatttgttaagcagtaagtctcatgttaagtgtttttaccacaataaaataaaatagtaaaataaaatgtacctgagatgagacttgcagtcctgtgtgagggacaggagtttgcccacagaggagagtgaagatggagagaatgttacagacaggccacagcctgctttgggacctagaagtgagtaaacaggctccctacaggatgtgcagacagctgggcctggggagagagtgccggggatgctctgagggccactgggaggtgaggctgtaaggcaagttgtggcagaccatcacaagcccttcatagacctgcaagagacttccaggtttatggtttgcctaacatgaggggctactgaagagttttgtgcaagacatgtgatgaagtatttgtgacatgataaaatgtcgtttcagccatcttaaaaccactcaaagttgacggtctcctctcctgcctcctgcggcttccattaccatggcagagactgtggtgtctgaggtggtgtagcgtactgaagcaaggctgtcttgaagaagaggagacaactcagtaagtatgttagtcagcataagctaggttatgatgcagtaacaaacaatgcttacatttcagtggcttagcacaacaggagggtatctctcactctttctggatgccctacagaagacagcgggaggtggggtgggtctgttccacagtgtcactcatggaccagactctgccatcttttgactgcactatctccaacacacgacctttttagtcaccacatcaggggagagacaactgcaagggtttgcagtggctcctttatgcttcacaatggaagtaacacatgccatttctttttgtagtcacagccaattccgtagctttgcctaaccacaggaggctggaagacggggtgggggggaagcagatgggtgcttgctgagcactgcagtctctgccatggtaatttcaggtagctagatggaagccacaggaggcaggagaggagaccatcagctttgagtggttttaagatggcagaaacatcaggccacagagactgaggcaatttggtgggggtgagagaggagtggcatagggtgattgctgggtactcactggtggcagcatactcagtgagcaaaactggcagagagtaggtgtagggtagagataaggctcatcttgaccagcactgctatctgcgaagcctaattaaacatgtccacggccggtcgcggtggcttcatgcctgtaatcccagcactttaggaggccaaggcaggcggatcatgaggtcaggagatctagactatcctggctaacacagtaaaaccccgtctgtattaaaattaaaaaattagccaggcgtggtggcatatgcatgtagtcccagctacttgggaggctgaggcaggagaatcacttgaacccaggaggcggaggttgcagtgagctgagatcatgccgctgcactccagcctgggcgacagagcgaggctctgtctcgaaaacaaaacaaaccaaaacaaaaccacaacaacagcaacaacaaaaaccccaaaaacatgtccactaggaactgcaagtcaggagtgcaaaatagagtcaggcctagctattgatatttggacatcatcacccagttataggcagaggttgaaaacatgtaggtgaatgagtctcccaaaggagagaatgtataataagattaggtgagagtttaaaaagttgaattgctcgtgcagtctggatccagagtcatcgcacccagatggattcaagaaatggagggtcagaaggtcagcttccacaagtctataattaactgggttttgatgtatgcttgcagaggctagagacacactgagagatttatcgagtgcaatatttgtttgacatccaaagaaataagacaagccttcttatgaactcttggcagagatttactttagatagcgaagaacagcttgacactacagattattagacaccacaagagtttattaaataaaatgggtggaagcattgattctacatcttaaatatatctctttggtccaggggttgtcaaactgtgtttcttaggggggtctcaggggctgctgcaggatgccaggagctggtgcagagcagagtgactcacgtcttccacctctccctccatcagctctgcggttactggttttatattgtaatgtttcacataagatttcattggagaaaaaattctgcaccacaaaaacaaaaagtttcctttccatctccaatgttaaaaagccttaggctgaggctttcatcatttcctgcttggatcgttgtatttttcttccctgggggtctgtctcgctgcctctgatctcgtccctttgtcatccaccctccgcatggttcccaaagtgatcattctcgaacacaaatccaaatctgatgttggcttctggggcatttttgacttcctatcaccaattgtagaaagttatactctaaagaatggccccaagaaagcatttcatgatttggccttcccttacctttctccagcccccttttcaggatgtccccttttgttccttgtgcctcagccataaacaacaactcatgcctgcagtgcgctgaaggtatagaaggcctttggtttagtgaatccaacttctcagctgcagcttcagcataatgacatcttagaagactccccagcttccagtagtttagttagaagtcctcctctggggctcctgtcatgaagaatgtgtacccctctgacagcacattgcccgcagtcttgtgttaattgatatttagtttatctccctactggataatcagcaattgccttcaggaaacggactggctcatcagctctatctcctcagactttggctctgcacttgaccctctaccatgttgttaaacaagaaatgagtgtcctcctttctggaaatcattaaaataatggttttttatctgctttattcatttgaaaagctttggtctatgaatatagactatacggctccttaagatttttgtctatattatttttgatttttttgttttttaacacctttagaatttcacagcctttataaatataatacttaaaagtaacatttcagagtatttggaaatactttttgactatttaaaacaaaatatgaaacatgaagtatagtaaagatataaaacgataatttagataaaaattctttctttcatggaaaacaccactgcattattcctgtttcaaatgtcctacagcattacatttttttttttttgcagcaactccactacacatttgttcatggtgttcacttcctacaagatacagtcaaaactccttagcctgatttccagagcctctgtaatctgacccaactgactttctcaaccacattacacactaatctttcacagatttttttttgctttatttaaaccttttcccctcatatttctatttattcttcttagcctttggtgaatgctttctatcagaggatttgtaccttcggatttttggaaaagtctgtaccattatatcttagcatattgcttatttgctgtttgtttatttatgtctttggaatttctctgaggcagatactagagcatttatgattcctaacttctgttttatatcctccattcctttatttttgtcctccatgtcacagagatgttctgttccatcttctaactcatcttcaagcatgatttgtcttgtataatccatttgcttagatttctaaagagatttaatgactgtacttacacttgacttttaagagcctgtttcataacttgctgtttttattttacagatgccatttcttcctttatattttaaatactgtaaacatacttattgtcagctctctttcatgttgttctattcttgttggttcctcatgtcctgtaagctgtctttcatgatgctaagtgtcctattttttaaaattctgttttattttgcttacgagtttacttcagaaggaagtatcttttctagagatccggataaccacctggggtggtttccactggtgttcctgtcagcaccttcaagacacactgattctgaattattttttgtgttagtttttcagcctggaattctgagtctattcctactcccacctgttgttcagtcttggggttcttatatctctagaagactcctattttacccacatggtggggctattggctcatttccagcagttatcttgggtatgcaggcagagatgatctggttccttcaaggttagtgcagtgctttctagggttctgattctgcacaggaagcccagttcttattccttctataaacatattttcctggccagcttctggccttgaatagccatgaaaatcccagactttgagacctgtaatctcccttagttccagatacattgtcatgttggctctatgttctagcatttggagatttcctttcttgcttttgtgttctgctatatatttaatatgtaaaaaaatgcttttaatccctatatctaaatgtctggaaatgttgtgttcaattccatcttatcctgttatttcttgactgtctgaatatgtagttcttatttctctcgttctctccattttgaataatctcccaaatgctctctgccttttgcaaattcactcattcttccaggacttgaggagtcactgaaggtaatgcttttttcctccagggaccaaattaacccctaggaagggtcttctatgaactcctttgacatccatttgacacttaatcattttctgttataattattatatggctattatttgttttcttgtgaaattataaaatctttgaaatttggggccatttcttaagcttcttgaatttcttcacctggtctcacaacaaattcttcctaatggaagaaaaacagaaaagaaagacacactaggatagagtaatttaaaatgttttagactttatttacgagggtccaagcacctaggaaaacaggatttgtttaaattttgcttactcattttattcaggattcatgaatttataaggccagagagatttcatataagatcctagattactaaaggaaaactgaaagattttatgtcaagcaatataaaattaatatgacagatgcaaccttagaaaatgtgtttcctgagattcctaaattagctacttttgtgggtgtctgcttagtatttggtcctgagtaaatgaataaacaaacagctacttctgagagctactttcacagggaaatgtttctgagttccagttcatgggagtttaggaaggtatgggatgcaaattacatttcaacactgaaccagccaatcaatccttgaacacttttgaagtctttagctttgcctgtgaacatgggaacacccaagggcaccttcaaattaaaaataaacatacattctaaggagtcctagatgtgtaatttggtagaaatttaaggggtgtctttttatagtaacggagtctataaagaaaatacaattcaggtgaggttacatcctttccagtcataaaagtgtatgtgaatgacatttaactcgaaattcaagtactttgggcatatcattcccgctccctgccccaatcccataatttcttggtagaaactcatagtgcatttttttttcagttccagccagatttttatatctattggatggatattacattaataaaaaaatagctaacacttattgtatgattgtctaatgccaagctatgttcgtataattatctaatatgttggtatgatttgactctgtggctccacccaaatctcacctttaattgtaatcccttatgttatgggaggaacctggtgggaggtgattggattatgggagcggtttccccatgctgttcttgtgatagtcagggagttcttaccagatctgatggttttagaagtggcaatttcccctatgcactctctctctctcctgccaccatgtaagacatgccttgcttctccctccccttctgccatgattgtaagtttcctgaggcctccccagccatgttgaactgtgagtcaattaaacctctttccttcatgaattacccagtctcaggtattctttataactgtgaaaatgggctaatacccagataaccctatggtgttgctgctgttattattcttcccttgcagatggggaaaactgagatgaagagttaattaatttaccaaagtcaaaagagtagtcttaaactactgtgaaatttctgtaggcctccttttttttccttcaaaacctttaatatgctaatacacatttttgtattttttttttaattatactttaagttctgggatacatgtgcagaacatgcaggtttgttacataggcatacacgtgtgattgtggtttgctgcacccatcaacctgtcatctacataagatatttctcttaatgctatccttcccttagccccacaccccactgacaggccccggtgtgtgatgttccactcccagtgtccatgtgttctcattgttcaactcccagttatgagtgagaatatgcaatgtttggttttctgttcctgtgttagtttgctgagaatgatggtttccagcttcatccatgtccctgcaaaggacatgaactcattcttttttatggctgcatagtattccatgatgtatatgtgccacattttctttatccaatctattgttgatgggcatttgggttggttccaagtctttgctattgttaacagtgccacagtaaacatacgtgtgcatgtgtctttatagcagaatgatttataatcctttgggtatatacccagtgatgggattgctgggtcaaatggtatttctagttctagatccttgaggaattgccacactgtcttccacaatggttgaactaatttacactcccaccaacagtgtaaaagcattcctatttctccgcatcctctccagcatcttttgtttcctgactttttaatgatcgccattctaacgggcatgagatggtatctcattgtggtttttatttgcatttctctaatgaccagtgatgatgagctttttgtcatatgtttgttggctgcataaatgtcttcttttgagaagtgtctgttcatatcctttgcccactttttgatgaagttgtttttttccttgtaacattttttaagttatttgtagattctggatattagccctttgtcagatggatagattgcaaaaattttctcccattctgtaggttgcctgttcactctggtgatagtttcttttgctgtgcagaagctctttagtttaattagataccatttgtcaattttggcttttgttgtctttaggcctcctttctattcatgtttctactttagaagacatatatatatatctacatatatatatattttatatatctatatatgccttctaaatatatatgtctacaaatatgtatgtcttctatattttatatatctatatatgccttctaaatatatatgtctacaaatatgtatgtcttctaaagtagaaacatgaatatatgtatctagaaacatatatgtcttcagaagacaaatatatatgtatatgtcttctaaagtgtgtgtatgtgtgtatgtttatatatgcgtgtatatatatatgtgtatatgtatttgtccagagttctcctggggaatctatattttattgagatgagaaggaaacgtggtagtgttggttaacttatcaccacctggttgctgtctaaactcaaccacttcctattgtgtcatggtttgattataaatttcctctaagcctctttttctggacactcgcttatcaccgctaatcctacatacaaaaggttgaatactggccactctgaaagttgacaatctaatatggattaaatgtaaaaataaagctagtgactccaaaacccaccactagctggttcatcacagttgtatatttttacactttctcagtccaccctctaacccaactcatcttcttgtaagcctagcacctattgttggctatctagtggcacactgcaaaggatcttatgtgcctggagccccggtttgcaattttttttttttttttttttttttttttttagagatagtgttgtatacttaaatcttgacaagcaaaagaaaaagaatgaagtttggaaaccatcacttctaaaaagcttgtattttattatttagaacagacttgcttaagggaaagataaaatcaatactttttccccctgttttcaataagtgcctagatattagattttatgtttgtttgttttaaacaacgttttaaacttgagagaattttgggtaagaaaataaataaataagttggatagaaataaaccttttaaaattaaattctcttcactaaagaatgtattactgggaaaggttttaaaaacttcactagaggtccctccaatttttttcacctgtttcctcaagatggggtagtcgaggacaaattgattactgttttaagcttccttccaaatttccattgctgttatttatggttctattccaaatgtaaaatttaggcctttccaatatttgtttttaaaatgaagagactttctgattcctatgaataaaaatactccatgctaatggaaaaatcaagaatcttggtgccaaagtgcttcattcaaactcttagacaataaaataagcaagacattaaattataacaaaggttccaaccttttactaaactagactcaccttgaggagcttataaaagtacagatttctaagttttcccaatctactctttcttcccatcccaagattctgaaattaattggtttggctgagcttgatccaacacattttactaaatatatatgtttattatatatagtctatattataaaataaatataattataacagaataaatataataaatatagtataaagtatatttattatataattatttaaggctgaagatcagtgtccacaaaggcatttcttgctctttgctaatgccagacaaattaatgcaaaagaaatggttggataagaagaaaggaaaatgagaaataatattcctatttataatttctatctattttcacaaaaatcacaagtagctaaaggtagtcattttgcctcaaattgccaatcaggtttaagaagttttttgtctgaatttcctaattctaagtgagagactgaaaatgcaaatgaactatgaccagaccacctatgacaacagaaccctgacccacaatctctgtggccaccagcccaggaagcaaaaccccacttctgtggccttcagcccagagtggtcagggcttggtcaatgactgccagctttccttttttttctttttttttttttttggcttctgcttccaactcaggaccaaggagagaaagccaaatatgttacccttctctaaacaatcacttaggatgccccacttctagttagtgcacttccagcttccctgaagccttcctttttttttttactgtaaaacgttcccattcccatctgtctttgagtctttgtcaaatacaggtgatggtggctgactcacttgctatggcaagctctgaatcaatagcttctgtttgttctcattttggtggtgtttatttagttccacatagctaaaaatggggaaaataaaaatgggaaaaaataaattatccttgtgcatacatgtaaggttatttataccaatttatgcaatttcagaaaatgagaggagaaagcagataccatcaccaaggcaagtgttcaaaagggcaataattacagtgacaagaggaatcccaataacttttattctcagtaaatatggctacacagtcaagagtgttgaggacctgagaatgggaagtcactgctttggctcctgtgattccaccaatacttgcctgaattctcttgaatcaatgaatcaggcgtggaagactagaagcaacaaagagaggagcaggtagtagagggggtaacttttagaaggctgtagagtggtcccttgatatccacagaggattggttccaggaccacccacatatacccaaatccatgcatacttaagtcgtgctattgggactttagaatccaggtatatgaaaagtcaaatgtgtatatgtgtgtgtatatatgtgtatatgtacatacatacatatatgtatatatatacatatacacacacatatgtgtatatatatatacacacacagagactttttccaaacaaaagcagatcaaaaatactgtatatatatatacatatatgtatgtgtatatatgcatacatatatacagtatatacatatatacacatacatatatgtatatatgtatgtgtatatatatgtatgtgtatatatatgtagtatttttgatctgcttttgtttggaaaaagtctgtgaataagtagacctgtgcagttcaaacccatcttattcaagagtcaactgtaatttcaatattttgtaacagtttagtcaccaatattgaagttgagagaaggaagttctctcttgtggacaatatggaatgctctaaaacttgaatccaaatgtacattcttggcatcactcaaataatgtgagcgtgtaacatttatgatatattcaagaggcaaaacccaattctttacactgtagacctgttttgttgttattttagttttgtgaaggcaaggttttaaggcaatttagttctaaaagcattactgagtatttactatttgcaattcactgcacttggtaataaactagagggagatgcagaaactctcttttctccaccaattcttcgaaggaaaaaacatttccattatcattaggtgacaatctacacagctaattgtacatatgaattgactgataatttacagttgcaatatggtgtcataaaaggagtcataaaactttgtgacttcgtttgctttttctctgtaagatatgtgctgcaaatgcaaactaacatcaaataaataactcctgtctttatacatacatgatctaatactttccacaactctgatatttaaggtacttccattatgactagttaattgcataaattcaataattaattatattctaatgatcaagaagaatatttatcaaaaataaaacttgcagacattggggaggaattaaggcatgttaacacattttctatatcaatcaggtacttttagtgtaaatgtgttatcaagtgaactggaacattaaatagaggaatttggtatcattgtgggaaaaataatctaatcacttttcaaacttggctgccctttggagccatttgagaaatttttgagaagcaagatacaggtattctaatttacttggtctgcagtgtggcccttgccaggtgatactaacatgtggcatagagtgagaaccatcattatataatctagaatttagtgtattactccttcaatattatacttctcctccagctcttgggacttttcctgatttcataggttggttgagcagtttttgttattgttgttgtttgtttttttaatgttgacttgttttcccaagtaggtattcttcctggaaagagatagtactcactataaataattaattgacttcctagtcaaattagtccttgatgagtctaaacagtgggtggtagacatatctcatctccccagtttgatcacgccatccgtccttaagataacagacctatagagctagtaggccaaccctagaaacaaaaaaggcaacagttatgtccaggtcattacagcttgtcaatttgcttctcccaaattactgcacttcttgtttcttcattgggttacacgcctgcttattcacgtccctcgatcagtttttcctcaatcctgggtacacaacagcatcacctggggagcattttagatgcctaatgcctaattacatcagtctctgggggtagtacccagttatcagtgttctttaaagctcctcagaagacactgtgaaccattgccttaggctgtagtgctctcaatatttacctaagacattcatgaatctgcattttctttagttgatattacagagctacagaccagctctgacccaagctcatttatataatggcagatagatactattaaaaacctaaaaaaaaatttaatagaagtctttggtaatgtacttacagagcccttgtactttgggccaggggctcttgtaagcactgtacatagattgaattatttattctagccacatcttacagatgagaaaatttcccagtgttacacacttagcgtttgggccaagattcaaatgaggcactctggctccagagtcaccagttaaccacaggtgaccagcaatgtggctgttaaaactactagatgtgatttgataggtgatattcttacacttccattttacaggtaaagaatcaaggtacagagaaagtgtcctaggatcacacagctagtaagtggcagagctgggatttgaactcaaaacagtcccaccctaaagatgatgttctgttaataatctagccttttttttcagacaaatattcaactgacccagctttccataaatttatattactgcagattggaatttggtattgcaagtttcatttgcacttctgaacttattcttcatgttttacccagaaatttattaaaaaaaaaaagaaataaaactggtggatttttcaccctactacaactgactgcactggagaagcaattactacagagatgctacagctgctttcttgatattagtccacggttttaaaatgtttttgatttgtaaatatgttaggcaccacaagtccgtcaagatggtatgtagaaagaagaaaagattctccactccaaatctttatgtgcctgaaaatccctttgatttcccttattagtttggtatgtctttaattttatattaaaaatacagatttcttccagttatgggacattgtcccacttcaaacttttaaaaacaaattaatcagaattttatggtaattgttatgtaaataggacaaatatatctcagccctttggcaagcagccttgacaactgaaacagtttcacactgtggatttcaatcaatgtaacaaagttactgagcacagtctaaaatcaatgaattctagagtgcaggagttttttaaaagtttcttgcttctcgcattttaatataaaaatcatcccaggctattgttaaaatgcaaaaatctgatttgggaggctttaagtgagatgctggacttcatatttcagtaaggtctcaagtgatgtacatgctgctggtctgtgaaccacactttgagtagcaaggacacagtgctggtaaactcgttctccaaaggaggaaaacaaagccttggcttgtagtatttgctaatttccatgatataaatgttcccacaaagaccacattcaagctaccaacgtgatgtcattgaaaatggagttgggaagagacattcagcacgctgcccacaattagctctccaaccaggtacaagccagttccagcacaccactgatctacataagtataagtacatgcaccttcaagatcccacaacatagctgtttcactctgcaaaggatttcaggaggtgagggagaataagaatgtcacaggaaaaaatgacaagattaattacaaagttttcagaataggtgcaaaataatctagttccaaggctatataggctgatgagagggcatgtttaagaagttaaaagacgtgtgtggccaataatggagcctttggggaagatctgaacccggtttggactgtgatgggtttggatgagtgggaaaggagaacacgcacagaaaaggaagtgggataaacactagcaaaatgtctgatgctaaacaaaattgaaggaaaacttggaattcctaaagagttgggagtacagtcattggtccagcagaatgagggcatcctgctttcacaaatgttttattctctggcatgattgaggaataacatattcagattaatcaaacatccaggttaacagagagttgacatatgtaccaaaaagagatgccaatgtttaaagtaatagaatatattagagtacacagaacctaatttctttcttctttgatgaagaaaggactttgagatcttccatgtctcagagccatggctttgagcacctttggtcccttctggtagggttctgtgatggagcctgcaaagttttgtttgcagtgtcctgtaagaagagtgtattttcaagtctttctctagggctgtagaatgagagcatcctaagaaactgactcccttggagagaatttctaactggcagaaatgctctgccttgtagtgcattgagtggttaaaagcccagactcatttccacatctgtaattggggctaataataccaatctcatatggttttggtgattattaaatgaaacttggtcaagaaatattggtgctcaatatttgaatgagcactacaaattagtgcaggcgttgtagccaggcatacaccgttactaatttttaaatcagaattgcttaacagacactgattgtctacaaggccataaacaggatgaggctgtggggagaaagtatggactggtccccaagcctgcagagctaaggtttctgcattctgcacacatctttgaaagaatctatgaccacctgtgcacaatgtttaaatgcctaggaaccttcccttgctacccagggagaggttttccctagaccctctgacagttccctcagtcagcaactatatgaaagaattttcttacatttctgaaatctgaatagaggtttatttgggaaaaaatccttttccctcctgtctcttggaataaatgtactatttcgttttcttaatttgtactatgttaagaaccagtagagggaacttaaggtcaatctgtctctcaggttgagtaactctaagctataagctccagaatcttgtctttgtctctaattccaaatgggcttgtggggaaaagtgatataaccatgagatcactgtgttcttttagatgatttcctgtttcctgtgtatttaaatacacagggaataatcccgctattaaaatgagaccctgtatgtgtgtatgggcagaagttcaatgaaaaaggaagaaaaatatgcttgctgaataccagatgtagaatgcataaatcctgtcagaacaagtggggaatagcttttatggctgacttgcaagaaacctaagggaattgggaaatcagataggcatgtgtcaagcagacttatttaaatcatccacttcctcagcaaaataaaagtttgagagggttctgcttccttttgtggtttgaaattacagttgtaggcctcagaagtcctgcttgattgagggcttccaagcaaagacgttatacaacctagttcaggcgcccgacaacactggggtcacccaatgcctctccctgaggtctccaaccttgccttgtttgtactttgtgtcctttgtcatctcagaagcaaattgtagtgcagctgaccactgcttcatggacctccagcttgtccctactaaaaggcttttgcatctgaaagagaaagatgcccactggcttccttcttagaccactgctgtagatcctgagcacaaaccttagctctgcaggcttggagaccaggcaatgctttctccttgcagcctcattctgttcacagttcgcacagggtttatggccttatagacaatcagtctgtggtaagcaattctgatttaaaaactaataatctgtgtatgcttggctacaaggcccacatgaattcgtagtgagagataaactagataccaattatttccaggtataatatcctaacaggtaagtttttcaggaggccacattgtagttcagcaggttactggtgtgtatagatacaaagcaaaggtatttaagtacaaaccatttcctttaaggtgtggtagctccctaaattgttcttctcaggatatttctgttttaaaatgtcctgttaaatatattatttttatgtacagtataattttttaaaagcatgctgacatgggaaaatcatggactttgcagacccaggtttaagtcattccaaatctaccacttactgatgtgtgaacttcagcacgttactgtacctctttcagactcatttccttatcttcttgctgagaatgtgtgtgtaaaaatattaatatggaatctagcatggtgtctagccctttgtgaaaccctgacaaattcttattcctcaccattcatctgttcatctgtattagtttgttttcacggtgctgataaagacatatccgaaactgggaacaaaaaaaggtttaattggacttacagttccacatggctggggaggcctcagaatcatgatgggaggcaaaaggcaccttttttttttttttatggagtttcactctgtcacccaggctggagtgcagtggcacgatcttggctcactgcaacctctgcctccagggttcaagcaattcccttgcctcagtctcccaagtagctgggattacaggttcctgcctccatgcctggttaatttttgtatttttagtagagacagggtttcgccatgttggccagactggtctcgaactcctcacctcaggtgatccactcacctcggcctcccaaagtgctgggattacaggcatgtacaagtatgcccagccccaaaaggcacttcttacatggcagcaacaagcgaaaaatgaggaagaagcaaaagcaaaaacccctgataagcccatctgatcttatgagacttattcatgaccacaagaacactatgggggaaactgcccccatgattcagttatctcccaccaggtccctcccacaacacgtgggaattatgggagtacaattcaagaggagatttgggtggggacacacagtcaaaccgtatcactacccatccatccatccattcatttattccttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgttgactgtgggccccaggatgtgtatgatggaatttactgaaacagaatttgcacatttataaaaaggatgcagttttagaaaatagctagttatgctagcatcttgtttcttcattgatgctgcaatgttatataagcactgaatcctcccacatttccagctcttatctaaaagccagaatgtgtaccacctgggttgagaggaagatgaaatgaaattggggaagtaaatggtaaaaagcatcctgaaagaaaccaactagatatgttcaagtcagcaggttatttagtattttgagttatttagtaatttgagtaatgtgtaaggggtgtactgacatgctttttctctcattttctccctgttctgcctgtagcaattctaccacctttgttgacctcttcttccccccaacttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatgtcatctgggactactatcattggaaggctcagctggggctggaggctacacttccaagatggctcacttatagggctattggtgggaggcttcagttcctctccacatgaaactttcctcatgccatggaactggcttccctcagagtgaaagacccaagagagagactaagacagaagctgcaatgtttttatgacctagtcttggaagtgacttactgtcatttctactgtattttattcattagaagcaagtcattaagtccagcccacattcaaagtaagaggatttaagctgaacctcttgaaaaaatggtatcaaagtatttacggacattttaaaaactaccacaatacatataggtgaacttcacaaggtgtagacatgggctgagacagaatattggataatatctcattctgcaaacagcagcctcatctgtaataaaatcccagcattcagaaattatcacgatcaagtaggaaaagggcttgttggaaaaaacttatcaaagatgttacttcatttatccatttattctgagccatagcataatagcgacaaattgtgtgtcctgtgtaatttggatacctctgctcaataatagctgaacagattttatcctatttttagaatagttaatatatacacatggcacaaaatttaaaaggtataaaagtttctggttcaaaaataagattccctcattttctttttttctgattctttgaatgcaattcgatttactgatttctcatgtagccttagaaagtattctatgtacttacaaacatatatgtacacatattttttctttcccacaaataaaatactgtatgcattgtttta

SEQ ID NO: 2617 - DNA, 109983 bp, Homo sapiens
ataacctcatactgtttattctcccaatattttatgagtttcaaagtattaaatgtattgtgttgattctgacaattctatgaagtaggaaatgtggagacatttatccgaagagagaaagtgaactacctaacaaaacagttaggaagtggtgggatcccaggtcggctcagttcttctggctggctgaccctgagtctagtgctttttccaccataatatacatgtgttgaattcagcaaagtgactgtctggaaaacaaattcttgtcgttaaaaactgcataataaaaacatttttgattctttttagtaccataaaagacatttaagggcatctgcctatagaaatcagttaattttgtagattacctattaatctacaatagtgaattaatgccttttacctattgtaccacctgaaacactggaattttgaaagtctgaaaccagaattaaatcaaacattctttttcaattaacagtttaaagttcatgaagtaatactaacagaaagctctgccaattctgacgagatgagaaagtctttgaagctcattttaccttccttaaaatggaaacccccttataccatcagctgtgtttattgagagtcattctaattattaatttttgccaaaatgttttttctttgaaatacaagaatcatcatgcttccagcttagatgtaatctaccttctacaatggcttatacaagaatatcacagaatctctggtgaaattatgatccaggattcatttcacatttcagttgtctaaaaagttttacatttctctataaaaaattaaaacttcaatataccaaaatcttaaaaacagtaaaaaatttaactggaacaatgactctcaattttaagagctggtcaagggaatgtaagtatatactttcaaagacacacaaaatgaatgaaaaaatgcagttcttcgaccagatgcagtggctcatgcctgtaatcccagcactttgggaggctgagatgggcggatcacttgaggtcaggagttcaagaccagcctggtcaacacggtgaaaccccgtctctactaaaaatacaaaaattagctaggcatggtggcaggcgcctgcaatcccagctactcaggaggctgaggcacgagtatcactggaatctgagaggcggaggttacagcgagctgagaccgcgccactgcactccagcctgggtgacaagagtgaggttccgtgttaaaaaacaaaaaatacggccaagtgcagtggctcatacctgtaatcccagcactttgggaggccaaggtgggcggatcacgaggtcaggatatcgagaccatcctggctaacatggtgaaaccctgtctctactaaaaaacacaaaaaattagccaggcatggtggcgggcacctgtagtcccagctactcgggaggctgaggcaggagaatggagtgaacccgggaggcagagcttgcagtgagccgagatcgtgccactgcaccagcctgggtgacagagcaagactctgtctaaaaaaaaaaaaaaaaaaaaaatacagttcttcaaatattattcaacatgtcgatgcacaagagttagcttgacagatctcttaaccaataccacagtcactgaataattttatgatcttgtttaaatcaaatattttcactgtgaaggaaaataggatatggcaaaacattcgattaaatggttggttatcaagtttaacatagttttacaaggtctaacggagaacacaaataaaatttggagaaggcagaagctattcatagttttaaaaaatcatgtcatccctatcaccacactgtaagtttacaattaataaagataatatgaagagtgcatgaataaagtcatattaataaaatgattcattttcttttgtttgactcgacttatcgatttaatatgaattaaatttaatttagagcaatgctgtgaaaatatatacaaagtccataaaaatgaaatatgctgtccttcaaatataaacatgcaaagatgatacaactaccacattgccagtagtaacacttcctgctaatttctctcccctacctacccataacagtgatttttattactgaataatccacattttaaaacttagttttacagcaagcttgtccaacccatgggccacatgatgactttgaatgtggctcaacataaattcataaattttctttaaatattatgagtttttttgtgttttttttattttattttttttaaactcatgagcaatcgttagtattagcgtatcttatgtgcggcccaagacaagtcttcttccaatgtggccctgggaagccaaaagattggacacccctcttctatagtagggactcttgagatggttgagtgtgatcttgattcagataaaataacatagaataaaacttctctgtacagagcctgttgtttggactggagactacataccataattactggaaaccaagccttaaaaaagtctaacaattgacaaacataattatatttaaaggttaaagaaagatgtaagttcattaatcctcaggaaataggatgtcctccttgacacctcagtctcaaaaaccacaccttttccaaagagttatactgtttatattattactttgcaatatatcttagaactctaaagctagtaaaaaaaagaaggtaatactcatagccagagggcccacttagcaatgtggcaggacaacgaatgaaggagtggctctagacagtctccctgagggctgtgagcagggagcccacttcatctccctaaacatgtaccgtcgtctaggaataggcagtttggtatggtgaggataagaagtactgagctagacatgactgccactagctatgtgaattctaacatgtcagcctctctgattctcggtttcactgtacagaaattgagtaataaaagttttgaggtcccagaagctctaaaatgatttcactccctatgattttcatgtttactctacttttcagagagttttgttgaagatcaaataaggatatatatgaaagcactttataaattttcatacaaatgcaagttgctgttattgtttcatagattttcttcattacactagaaaagcatggaaacagttttgagatacaatataagatgtttactacatggtaaggcatttagatgggctatgccctaaaattaaacaaaaaatgttaaaattgtaatttttttcttctaaaaattactcagggaagatgttatagttttaatttttataggattatctgatttgttaagaacttagactaatagcttaatgaacagttcctaaaataagcatctcataggagctgtatccagcttttctggatacaagtaacctattactcacatagatgccagctgtattcaaagaaaaaaatacattttagaatccctttcatattcattccttggataattcttttacctagagcagcagtacccaacttttttggcaccagggaccaggttcatggaagacaatttttccatggacttgggggcaggggatgaggaaaggtgaacggttttgggatgaaactattccacctcagatcaggcattagattctcataaggagctcacaacctagatccctacgtgtgccgttcacagtagaatctaatgatgtcactgatctgacaggaggcggagttcatacagtaatgctcccagctctaccactcacctcctgctgtgcacctaggcgtgtgggtcgggggtcaggacccctgatctagggaataaaatgtgaattcctcagtgcggtatgatttgacccaatctacctctgcaaacttagttcgccttaaacacattcatctcaccttttccagtcaaaccaagactcaaaccactccccagccataccaagctctcttctaagtattgttaaaaaaaaattattcaatgatacttgttaaagcacagtaagaaagactttattcagggctactgcagtaggtacagggactactgcaatgggattttgcagttggggagaaagattggctgaactccaaatacagcatgggcaagtgggaaagaggaaagtcgagagaaaaggagtaatcacgagtggctcctagttatctctaaacaactgggtgaatggtgctgtggaatactgggattaggaaaacttggtagtaggggaagtggaggtggagggaagggtttttggggcaaaaaacccaagagttccattggaacacataaagtttgagaatattttagctctcctattcctctttattctggtgacactttgtttacactgtgatttcagaatttgtcacattctgacttaatttggtgcatacttatttgtctccctagccagactagaggttcctgaaggcagagactgtaacatttactccacatgctaaatagatggccttaaacaaggtggtcacttaaaatgattttagaatgaataaatgaagcattctagaaattgtgaggaatacaaatcaaagaagagagaaatgcttacttttctagcagtctccgttacctagaactcaccttgaaaaagatcaataaaagttacaacagaacataaacccactgcagagtctagcactctagcatgtaaacccacttacatatatataaaatcaacccctactcttaagtctcctagcatgagcgctaatgggctcatacttactagctctgtgtaaatagctttcttttatactgtccaaaggcaaatatcgacagatgtgacttgtatatttcagataggttttcagtgagatttttatttttaaacattctatttacatgatttgtttttgtagtcatgtatttcagattctaatagattattcgtacaatcaacacttaattatttatccactttacaaactgatttgaacactgaatagaatcacagaatttttaaagcagaaactcaccatagccagagccctcatttatttggagggatgagaaaactctggcctgaagaaactgctcaagattccatgtttagaaatagagttaggtctgaaaactagctcacctggttcctaaggcaggattttttttcataaacactggcttcttaataaaagagattaatttggccattttgagatggaccacatattatgcttttgaaatttttctgttcagtgatatctcaatgacatttctaagaaagatacgccttaaaatgaggttagacatattagtaaccaaatggcttaatggtcatgcttctgagatagtatgtgcagggatataaatatccctcttatggcctacatggccatggaaactgaagcgaaatggagccaatcctatatataattgtgaagtctgaaaggcttgcctttatcatatccctctttccctttaatttgtctcagtggtaatccttcttcccatttcaaaggccttcctacctattccctctgctctttccctttacaaaaaatgaaaaaaaaatttgtatgtattatctatatcttgttggcagacagacataagatactgcttaaatgaattttaaacaatatattaactcaaccagatatttaccttctaagctcttaatcctgaattgtggaatgaaaagtttgttcccagacagctggtagggatagagtggtggagagaggttccctccctcctagttataagaatgacaaggtctgaagccaagccaagtatctatttagggcgaaaagaataatctaaagaagtagtacatgacgcagctccactggaaataacaatagcccacactattactttagtttctggcagatatctggaacactagaaattaaacatttctaaggtttgagataactgttattaattattatagtgacttgaaattagatttcaaagtagttcaaagttagcttacacatattcatcatgtttacaatataaatatgttatattcacatagcaccttatgcttatagtgttttcatatgtgcaatctcatttaaacttcaacaatatataatataaatatcattttcagttttcaaatgaagagtctaaggtttgcaggtaataagggttataaaaggcacagccagggttgagcataagagttgtgaatccaagcattttctcactataacatgtaacctatacagcaatattaaaataacttgtatatgtaagttccaaatactttcaaggtaaaaaagtggtatatattgtcctcaaatttctaagtaaattatgctgatcttctcatacgcaaattttctttttcatataatttttgtaaaagataattgttattttcagctttcttacctttctaaaagaattcagtaatagaaaaaatactgtcaaaaacatatagctaatgaacagaaaaagtcatctttcaataccacaaaaacatttctcacttagatgtttttcctttgacatcctttaaaaaccttattgaaactcatttaaaatatttgccaaaacaattgtatagttcacttcagtgattcagtatagttatgtaacaagcttttttgcatattttgttaatttgccctttaatgggatgtgatatcactacaggttacatcctatttctgccaaaatgtattttaccttggctttccttgaaatgaattataacatgggattatccatctatgatgggttctttatctaattgggaaactgaatcagatttaacatcatgcaggtttaaaactcacgtgttttgctagttttaaattattatctgttaatagcacataggttcagtgtatctactgttaccaattccaaacttacttttgaaataaccttggtgattttaaggacaaaagagatgctagaatataatttgtcaagtgtaaaaaccgaccattatgagctttatttctaaagaaataagtgatattcatcaacacaacaagcatctgaacatttaaaagaattgtcaaagtaagaaaggggctcaccggtctgagtgaaaccaaactgatgtagaatctcttgagcggtcagcatgtttgactgctttaacttagactgttgtgaggaaactgctggtggtgaagtaaatgagagatttttgttgacctgtattaggaaaacaaatcagaaactacagtgtaatttcctggattactaatgcaaaaactggatgagaaatatttgcttattatacaaaccaggacacatgataggtcaaaaggagtggtaatgatgtacatggttagtttgtaaactttacaaaagagaatcattttcatcaagaaaaaaatataatagtaattagaacatagctatatgaaaataaatcagccttactgaagtttaccatggacttgacattattaataacttagagtggtcttaagttatgcaaagtaatgcaagaaataaaaatgactccttgactggttcaattaaggaagggtaaaaatgtttcatattcacatttccctagcattttagtgaaatagcaagtacttccttttcagagatacacagaaaacacctgtactactcatgtttatatacatcatggtgacacagataacacagctgtaacctagcttgccatgtgaaatagtatccattgcatcaaaacaccttactcaggatactgtttaaaaatatcattaaaataagaaggaaaatttctgtaagtaaatacaatgttctataacatacaaaacctagtatgattatctgagtgcacactagcctcacagaaatgaaatgcataataaacacaacattttaactatagctcttgtaggaaaataaatagttcactgaaaaagcttgaaatgtttataggcaaattcatcttgtaaatcagaattcgtttcagaaaaaaaatctatctttttttcattattaacaaatcaatcatttaatctttttcattactttcaaaaagcacaataaaatgtgatctattttggagaaattgacagtctgattcctaattcacttcaaaaatgtaatctgtaaataaacaaaatgataatttatggcatataaatattactatattaaaacagcccctttcccatttttttgttaaataatgaaaaccatacagaggacttctactgtgcaagcatttaaaattttccttttgatgttctgtataagacaatactgggctcttgttacatgccctttatctgattcattatttacatgtttgtaaatttttttttctattttttgcttttaaacagtgataataaacagtatatcttagtttaggtttttctcttagagcagagttagcaaattcagtgaaaaagtcaattaagaccatatgttaatatggttttaaagtaactaaactattatgtcatctcaataaaaaataaaagtattttccaaagtagttgggggggtcaaataccacatcagtcctaaaatatcacccagctttaaaaattctatcaaaatccattaaatacagatcaaaactgaccagttatagtgatacaatacctaaaacaacaaactcatttgatatctttgagcttcactttccatctttaaatggagataagaaaaataatatctatacttcaatgcgaatgtgccaggaaagcaataatgatgaacgggtatcataaagtgctattcatatgttaaccataaagcactaatgaacattaaataagaaatagattaaatagaatatcttggcaagggcaaaccataaagtagtatacaaataaggtgttatattagttattattaacatcactagaagtaagggtaattaggtatttatgatgtcatatgatgatgtagccaatttttcagagttctgtgctttcaaatggaaaagaacatatttatcacttaactatttaattcacttctttttggaatcatttctcagttttacttcctgaaaatttttatcttaaaatcaagtaatgcatttaaaaatctggtgcaaacaaacaggtgtatgctggagaaatgaagatatatctatatacacacacatctttgcacacacacacacctacatatatccatatctatagatatagatatatctatagatacacacaatagccatttatagtcttcttcttcagaaatttgtgttaaaaacaaaaaatacctggaaagttaaaataggatacttaaatgcctctgttcaaacagaaagacttgtcattcttttacaacaaaatttttttttaaaaaacctgtaatctataattatatgttcttcctaaacatttttataattctgatctttcttgacatagttttttacagactattcaaatgtccataaagtgatgagagcagcaacgtaacagagcagataatttctaaagtttggggtaactgttaattattactgttattattagatatttgttttgaaattagaactcaaatcattttcaaagcaagctcgtacatatttattattccatttagaggaagaaaaataataataaccattaaatagagtgaagcaatatctatttttgaaatatgtgctgcggaaaagaattgcttaataattttacaacaacagaaaggttggttaagatagtctaccctacaccaatctaccctcttttcacaacacccttttctgtttgcttcatgcaaaaaccacagtctgccaaagtcagtttaatacctccatattggagaaaactaaaagcataaaaatttaatgaaattcataataaagaaaaaaaatcatctggaacttctgccaagttaatcataaaactgttttgcctactcttttagggtataagcagacaagcaaaatatgcaaatactaattctctagacgggggttaattttcatgttaaaaaacttgctgctctgaacatgaaattgaatgcacaatattaagcaagctgacaattagtttctcttttagtgattagttaaaatttaaaacctttgggagatatatagtactcatttccatgtatacttacaagtctacccttttagctaattttagataacacgctacattcacctgaagaattgtttatgaagtttcaagctgtgatgatatcatatctcaagttggttttaaattataaccgaaagaatgttaatgctgtctgtatacttaaaagttcacaaattcatctctctcccagacagctgtcatatttttccactaatatgaataataatgcagataatattttaatctgatggcagttctggtggcattagaaaaaaagaaaccaataatacccaggatgttttttttttttttttttttttgcaaatcatgtatctgttgtaaaaattaaaatatcagtattaaagaaaaagttaaacagaaaacttgagccaaagtgaggttcaagatatttgaagtcaggtatcttttacattctcataatataaattttaagagtagcttatgctcttgtgatttctagcttagtaaagtctaagcaatgagtagtctatggtattataaagagcaattcaaatatgacccctcagtcctcagatgttttctttacaagccaggacagagaagtgaaggatttggaagacaacactgtaactgttaaagaaaaatttctacagcaataagataccagaaaaatcttacccccaaaccagttcattactactacattagctaaaaccagtattcaaatttgaatcagtcactataaagttttttggttatatttaatcgtgatttttgaccctctgataggtaccaaggactggtggttcacagattactgatatgacactttcatgtcaatttcaaaattaagatctagtcctggctcaaaccaattatccagcaatattctttagggtaaagcaatttacctcaatgcatcttggttttctcaaaacctttacctccttttctctcttagttcactgccttgcttcacagagaaaatttggtcttgaacccctgaacttctcatttccaaacttatgaaagaatggacctctcccacctatccttatgtctttacttctagggttagaggaagaggagcattctgttcaagattcatccctcagtccccttagggttatccttaaagctcttccaaattctaccttcaggccaggcccaacgactaatgcttataatcccagcaatttgggaggctgaggcaggaggatcacttgagtccaagagttcaagaccagcctgggcaacacagtgagacctcatctctacaaaaaaataaaaaattagctgggcgtggcagtgcacacctgtggtctcagctacccaggaggctgaggcaggagaactgcttaagtccagaaggtcgaggctgcattgagctgtgatgatgctactgcactcagcttgggtgacagggaagaccctgcttcaaaacgaaaaattctactttcgaattcctactggctatttccctgcaggttagaagcatagacccttctattttagtacaaaaacaaagaggaaacaaaccaactaaaactctccctctgattccgttacttccttaagcttcgttaaaagctaaactccttgaaaaacagcacacaactgcaatccatatatctgaatccttcagtcttcaaccgggtacaacaaagcttgtctccatgataaaactaaattggacttatggtaaccctggacttcaaatgatcaaattcagcagattcacttaggcctctatccttctatctttgtttctggggagccatcttctcttggttatcctgctatgtccagccattcctcatcagtgctatttgttagatccgctgagctcctcttcttccttcacgtcacataattacactgggcagaaacatttgttttcatcaattcatctgccttctaatgctgatgtttcttaaatctaaaacacatctcctgatcattaagttcaaaactaaactaacctttgccccactgtttactttcttagggaaagccatcattctccacctacttgccaaggccagaaagctgggactcatactagattgctcaccacgctccacatatagattactatagtttgtactactcttccagttaagccagtcttccaaatagtgccaacataataaatctttttttaaaaactcttcttttaggtccaggggtgcatgtgaagcttgcacaggtaaactcgtgtcacagggacttgtatggattattacatcacacgggtattaagtccagtccccaatagttatcttttctgctcctctctctcctcccaccctttgccctcaagtagacctcagtgtctgttgtttcctttttgtgtttgtaagttctcatcttaatttgcagttatccagttttggaatgccacgaaaaaataattatgtttttaaaaattattttttaaaaaaacctttccaaataattgaaaaacactattctactcaaatctcaaaaatatccaaatatacgttttaaacagaaaaattaaaaaaatattttctctggattctctattttctgaacctttaaaaaaatgttttcagtgaataatatgttccgaggtggattcgactacaatatacattaccactttacctttacagcactcttccactaaacataactcaataaacttcaacttggctgaatttatattcatctagggtaggtgatgtaatacttcaaaaaaaaaaaagatgaagtttcctggcttcaagaagcttacagaggtgtgtggagggacagatacataaagattagaagcgaaagcagttattatgtaaaatttaaagagacagaaaaagagagtgtgtgttattcctccctgaggtaatttataatctaatgtcaaaaagaaaaaaattaagctgaaagctaagtcattcaaagagttccttttctttttattcataagcagatagctacagataaaaggttaaatatctccgcaggtagctttcatgttcaccttatcttttgaaaagtgtcaatttactgagtgtgagatgaatacataattgactatccccctacatgcatcttttctcttgcaacttgaggattcagtaatgtgaccatacctttcttttctcctccagcctgtttttttccctttaaatattgaagcccccaaaatcatctttggagaaaggcagacccacagactgtgtctgtgattcttgttttttcttctgggtcctatccttaacctcagcaaaataaacttctaaattgttgagacctgtctcagatactttttggtttacaattgtttccccttgcttgctcactacactacttaagcaaagtggtcttctttctgctctttgagcatgccagttttcttcctagatgaggatttttgcaggacatgactagctccttgttaagtgtttctctcagcaaggccttctatgaccatcctcttgagagtagcttcccttcccagtcattctttgtcccatgaacctattttattttcttcacatcacttattatctgaaactaccttatttgtttccttttaagattatgtgtctctctacaataaaaggttcttgttcactattacattccaagcacttagaaaaatacttggtagatactcaataaatacttgcttaaagaatgctaatggaaaaaacaagcgagccttcaacaatataaaaatactgtagaagggcaaaaacttatgtaacggacacttgggaaaaatttattatcctagatctaatagatgataaactgcataaatacactctgttgttaagattaaagatttttgacaagggtgccaacaccagtcaaagggcaaagcactcttttcaataagtagtgctgagacaactggatagcctcatgcaatagaatgaaagtggacctatccatcataccatatacaaaaattaatgcaaaataatcacagacctgaatgtaagatttaaaactataaaaatcttaagaagaaaacataggagtaaatctttgtgacacaaggctagaaaatggttttttattacaacacaaaaagcacaagtgacaaaagaaaaaataaactgaacctcataaaaaaacctttttgtttcaaaagacatcattaagaaagtgaaaagacaatccacaaaatgggataaaatatttgcaaatcatctaactcataagacacttgtatctagaatatataaagaacttaaaagtaaacaataaaaagacaaaaaatcccaattttaaaaccaggtgaaatatttaaacagacatttctccagaaaaaaaagtacaaatggcatataaaaaacgctcaacatcattagtcataaagaaaacacaaatcaaaatcactatgatataaccacttttcacccactaggatggctataaagaagagaatacaagtgttggtgaggatgagaagaaactggaacctcattcgtacactgctggtggaattcgaaaatggttcacatgctctggaaaaagttttgggagttcttcaaagtgtcaaacatagttaccatattacccaacagttccactcctagatacatatcccatagaaatgagaatatatatccacaccaaaacttatacacacaatgtttgtaggagtattatcttaatagctaaaaagtagaaacaacccaaatgttcataaactgatcaaatataacaatacgtaacctattcatacaatgaaatcttatttggcaataaaaagtagtgcagttgacccttgaacaacatgagtttgaactgtgcaggtccacctataggtggattttttttcagtaagttacaccaagagtgcctgcctctcctgcctccccttcccacttctccacctcttctgcctctgcccccagtgaaatagcaagaccaaaccctcattttcctcctcaggctattcaatgtgaagacaaaggaagacctctatgatgattcactttgcttaatgaatagtaaatgtacatcctcttccttttaattttcttaataacattttctgttctctggcttactttaagaatatagtatataatacacataacacataaaatatgtgttaactgtttacattatcagtaaggcttccagtcaacagcaggcgatgagtacttatttttttggggagtcaaaagttatacattaatttttgactgcacaggtggttggtccccctaatccctgtgttgttcactgatatatgttacaaatagaggaatcctgaaaacgttattttgagtaaaagaagtcagttataaatgactacataccatctgactccatttatatgaaatgttcagattagacaaatctataaagcatattaatggctgccaggaatttggggtatgttccaagagtttgtatttggagtgtgtatgtgtaggaattgggaatgactgctaagagatatggggcttcattcaggggtgatgaaaaactctaaaatcagatagtagggatggctgcaaaactttgtgaatatggtaaaaaccagtgaactgtatattttaaaagagtgggcattacggtatataaattatagctcaataaaactattataaaaaaagaataactgaagatactagtaaggttaatttttccagacactgattcatttccaaattaatcattttttcaatgagtatttattctacctttattaaatactagggatatgaagatgaatggcatgatccttcacccttggggagtttccagattagtagaggctgttctccataaagccttgctcaatctgtgcaggacactttattctctggacattcagacagcattccaaaagaagagtatgcagtacatttgttaaataaagagaaatagctttgaattgctagtcagaaaataaattgtatttttgcctctgattttatacacaatgagtacttcagaaggtttagtaatcttggagctacaatcattacaccaatcattgctatcaggaacgtttcctgaacatctgcagtacaagtcagaatatagcttgttctcttttcccccctcgtcttccttccccttgtctatattccatatcctgttgacttgtgataattaggtataaaagtgatgggttctgtgactgatgctggacagctcagtgatggggtaagtcttgtattttctgacatgttcctccctccctaacatgccccatcaggaaagcgacaatagcctattgcattccaagtgcctactaccaaatggtagtaggtgcccactgaattaaaaaaaaaaaaaaattccattgcactgacattatatgaagcagtctctaaatatactaacattctaattctttccttctggatgttttaccttctctttgtgatatgtaattatatttgttaaatgaatagacgtctaattattcaactgaattttgggagtggacagaagagggaaggatgaactcatgttgccattccaactccttattttcccaacacctaaattaaaagttacacataaaataaccttgcttgtaaaagaggaaagctgctgtgttgaaagcatataagatacaatttagttgaaattgtttactaatcgagagcctttttgtacactaccatttttagactaacttgggaccttgggcaaatcactcaacctgaataaacttcagtctcctcctttctaaaattggaataacaattatatctaatccatctctcaggattattatacagtatagttaaatgagaaaagaaatgtgaaagacttataaatgaaggagagcattatcagtacaataaatcatttatgtacagcttgcatgcatttcaatgcttatacagtttactcagcatatacctactggaactatattgaccggtgtcttatacaaattaaatatcatataaaatttttctcagagaatgacatgaccttgttgatcctttactgaaagtatctccatcacttagtattcttaaatctttaaaaatgtgaagctacttgctaaatgatcacccttactaaattatcagcttccagtattgtaattctgtgataaagctgagctccaataatgaaagtacacatcagattaactcttataaaggttccaaactctatgaatggtgcattccagttctttggagcatcactatacctttgaagttatcttcctggtaataaaaactacttacttttgcagcacaggaacgtatcacctcctaaaagaaatacaataaaataaggaagtattcataatttcattaaatattgactgtttgcaaaacactcagatgtttatcttctaataacctaaatcagcatttggaagtttctttatccattatcctgccgttgtcactctgcattgtttccaatgaaagagacttaatgacatgttcaaggtaaatctaacttgcccaaacaaatggcactgtgaaactcccgagggctcacaggttatctgcctcaagaaaaacttgctcttcaatcaatagaataaaattctatactagaacactaacaggtgtaaaagacacatgctgagttaaatgcaatatataattatctctataaataataatagccataactatcattcccatattatttgtatcagatgaaatctaatattaaatagtaaatactactaaatgataaaatatatgactattattgaaagagctacagaaaggaactctgtacaattcatggtacacggccaagaaaagatcattttgaaagagaaactagtaaaagtcgatgtattatggacaatttgaaaatctgctgctaaggagagagtaaaaatactcaagtctggccgggtacggtggctcacgccttgtaatcccagcactttgggaggccgaggcaggcagatcacgaggtcaagagatcgagaccatcctgggccaacgtggtgaaaccccatctctactaaaaatacaaaaatcagctaggcgttgtggcgcgtacctgtagtcccagctactcgggaggctgaggcaggagaatcacttgaatctgggaggtggaggttgtagtgagccaagattgcgccactgcactccagcctgggcgacagagtgagactccaactcaaaaaaaaaaaaaaagaaaaaaaaaagaaaaagaaaaagaaaaagaaaaaaaaatactcaagtccagtccaattaggagttagccagcatatagcatcagcctagtacagtgctagtgaaaaatggtcataatcaacatggagtttaggaaaaaaaagaactgaaaaaaatagatacttctcagttattgggagcattaccatttagtcataatataaatcatttaattatttatcagcatacttgactgcatgttgctgccacagcaatacctaaaagcattctgcaacctaggtaagacctcacaggtggacagtaccttgagaacatcggtatatctcattctaagtttttagatccagaaatttgattttatcagtgcatccacagttgctcaaaatctggaatacctattaatttttttatctataaatttctaagagccagatactgtatctaaagcgtatcagtaattcagtcactaaaaggagacagttaaactgactgtggacatgggagtccaactacctgggctgaatcccagctccagtgcttactacttgtgtgatcttggttatgtggcttgatctctgtaagcctcaaaatcctcttctggaaaatgggaataatactcaaccctataggatggtttgagaattaaatacaataaaatgtaaagcctttagcacagtgccagaaatatatcaattattactaataattaagcagatgttagttatcattaatcaatatatacggtggtatctcctgtggggtagagaaaattaatcttttttcaaaattggcataaaacattttcgaacccattcaatccatactcctatggctctacttagcaatcaactctgtgatcattagcctgggcttcaggttaaatttagacaggatgagatcttgagtgttcaggctgccagaatggtctaccttttattatattataaggtgtattttcatggattctcatttgttaatcaactttttgtaggattgattaatcttaatagatactacagattctgagcaaccctggatgcactgataaaatcaaatttctggatctgaaaacttagaatgagatttaccaacgctctcaagatacccgtgaagtcttacctgggttgcagaatgctgttaggtattgctgtggcagcaacatgcagtcaagtatgctaattatgaaataattaagtgatttatattatgactaaatggtaatgctcccaataaccgacaattatctattttttgtatcttttactcattaatgcctaaacacctattatatacctgctgaactgaatttattatgcaattcactcacacataccccacaaaaattacaccctaaacctgtaccataatttattagaaaaacattcctattgtaataaaaaataaataaaaaaaggaatttggggtctactgaaataaatggcaagaaacgagaaaaggcataatgacaaaaggtgggaattcagtcaacctaaatgtttgcacaatatagaatgaggctgccatgggaataaagacgacactttgtttttattcccatacatactatgtacattctgaaagaaaatacattgcagatagcatcagaaaaataaattcagtgaattctctcaacaaaggaaaaataatggtttttaaaaaccaaagcaaaactttcatttccaaaggcagcttctatctacctcaataccaaagcagacatattctctaaataattttaaaaagaaatgatatgctaaaagctaaataaagtaataattcaaagtaaatttttttataataaattatcaatttgcttctctcttgcgtttgatttcatttcttaaaaaacatttttctgccgggcacagtggctcatgcctgtaatcccagcactttgggaggccgaggtgggcggatcacaaggtcaggagatcgagatcatcctggctaacacggtgaaaccccgtctctactaaaaatacaaaaagcctactaaaaatacaaaaaaaaattaatcgggcgtggtggcgggcacctgtagtcccagctactcgggaggctgaggcaggagaatggcgtgaacccaggaggcagagcttgcagtgagctgagatcgtgccactgtactccagcctgggcgacagagtgagattccgtctcaaaaaaaaaaaaaaatttctgattttatttttcctttacatctactttctttagttcttacatcctttcatttatctgaggatgacaggtatataaaatgaaattagaaaaaagctacaagacttagttgattccaggatgttaagttttacagaataaagacggatagactgtaggaaacttgtttttataaatctgttggtgagttgtttttatgcctgtagatgaagttactttgccatgcaagtttttagacaaggaacacattttcttttttttcctagtgaagaaatatgtttctcttcatctttaaagctcaatgtatctattcagacttccttttaaaatctggaacagcatgcattatttgattatattaaaaatgttaaaatacaaagaactgcaatattgaaataaatttattaatttatagttatatattctaaaagttaactaagaaatatatatacttttctatattcctacatttattctgggtttaggttaaatctaaacccagagatggaatgtaatctgcatcctgatacaccttcaagtctctaactttagaaagaagagagaggaagagagcatagtcagaactaaagctgtctcaatgtagttccttgtatagtttaaaactaatcaagatatctatcaaggaagcaagaaaagggataacatttattaaagaaggtaagaataaaacaatgaacaagggtgcacagcccctgtcttcaaggagctcaaagtaattctaataaaaggacttccacttaattctactagaagtatggtcaaagatatttctcaggatgcttaggcttcttactacatttgaccatttatctttgagaaaaattttctaggaattttcactaacagaatgctacactacctttaacaaagcatcttcctcctcatcattttcatgatctattttccaattttatgggaaatacctggtttatgtggtacttttcttatgagtagtgagatagaacttttaaaatatgcctatgaaacatttctatctcctccttttagaagaacagtttatttctttcactcatttctttgttaaagatttactatttttcttcactgtttaattatttgcatgttaaaagggctgtttctttaatacattttatataaacatttccccaggctggtgtttgttgcacatatatgtgtgtgtttgtatgttttgtatatacacacaaatatacacatccttatatttttaaacagagaaatttaaaattctatgtcaataatctattaatattttgggagaggatcttccactgcttttaaaattagtatgttttcattcatttgagaaataattgcaagtgtatttccctagtttttaaaaagatctggattttcatatttaactccttggtaaatgagaatttgatttaggtgagtgacctaagatatatatgtaaatggactgtatttttcagttaactcatagttaacaaggtttcccaacaccatacaagggaacaattcttcctttccccactgatttatctttctatcttagtgaatttcaattatactactagtattatttcagcttcattattactttggctctcatggagaagttcgaaggtagcttagttcctatgtagataaccagtctttttttctcccccccattatatctatgatttttctttaagaaatctttaaaaatcaagcgatttcactaggatatttctaagatactggcatcttttcattaattggtctggtaatagatactttcattttatagattttgggactttagcacaggaaggccttttgtatttgatctttgttatctcttttcacacatgctggtctcttctttaacaacactgatcaactatatgcacaatctatctcatattcatctcttctctcattatcaacaataataactaacatttatcagtggcactatgtatcagacaccctgttaagaggtttacttttagggtcttactgaatcttaaaaatcctgtaaggtaagaaatactacaatccccataatggctcatgcctgaaatcccaatactctgggaggctgaggcaagagcactgctgactgcttgaggctaggagttggagaccagcctgggctacataccaagaccctgtctctacaaaaaaaatttttttaattagccaggcctggtggtgtgtgcctacagtcccagctactcaagagtcagaggcaggagaattgcttgagcccaggcgttcgagactgcagtgagcaatgatcacaccactgcattccaacctgggccacaaagtgagaccctgtctctaaattaaaacaaaacaaaacaaccaaaaaccacctcattttatagatgaggaaaactaggtttacttaaacttctccagtcaaaaagctggcacaggttggagcctatgccattcctatgcctaagcagctggaccccagagctacactctaaaccatagttttcacctatctctttttttctgtattcttgcgtgcttctgaaattagttctctacgctacactattgatctggtattttaaagtgtcaactttctcttttaccatttgcaatgtggaattaattgaagcttaccttttgattttctttaaattcattttatcttagatgtctttctaaaatcaaaatcttgggactctcatctcttcattaatagaaattctgttttcttctattttactgagaacacactctaaatattctgtttcttatagcaaagcattttaagatacgctttgcctttacttattttccttttttggggaagcagggacacagtctcattttgtcacccaggctggagtgcagtggcaggatctcgcctcactgaaacctctgcctgtctggttcaagtgattcttgtgcctcagccacctgagtggctgagattacaggtgtacgccaccatgctgggctgataaagtcacagcttctctttctttcctaggagatggagtcatacctgtatgctaagtcctaggtgtggtcatctggttcagagccctcccttatcactaggtgctgggctagcctttacagagatatcaagtcagaacagcatgatagattatcctaaattcaggttgtctgttgcaattaaggttttaggaataagtacctgaaaggaaccataaaagtataggaaggtctaattttaagtaattaacttacttcattaaatgaatatttattggcatggcaatgtaaaacaggatagaaatagttttaaagtttcaactgcataaaataaacttactgtgacagtttcaagcctctgttttactagctgcatcttcgttgaagaactttcagtgtggacaaattcatcaatctgaaaagagccttgatggggtagttttggacaggtacatagggcatcttgactttggtgtattccaggtaatggaaatgttccattgtagcgtttgaacatttcagcctcctgctgggcaactgaagaaatgaatccataattagttaaatcatcatagcaaaagcataatcaagccctaaaactgtagcattcaacaaataatcagaaactgcataacacatcttaaaaactgggtaataataagacaccataactagcaaaatttgaaattattcaatgctataaaatcataaggaagcaaatagaatttcatgtcaggcagcattataattgagctgtgaaggccatgtaaactgggatgggagactaactttaaatatatgtatatagaaaaataatactaaaaaatcaaaggcataacagaattaagggaaatgctaaaataatatttattcacaagcctctctaaaacaactattttcatatttctgtacccttcttaatttttacacacacattctatatatcataatgtaaatacaatttaacatttctcaatttaaatgcaagtatttcttacatttctacaatgacgtaattataattattaaatgttttacagtatctcatttaatgaagcaccgtaattttttttttacacattctcttatactgaatacagttggtccactgtatctgtggcttccctatccatgaattcaaccaactatggataaaaaatattcagaaaaaaataacaatactataaaaaatacagtatgataactatttacatagcatttatactatattaggtattgtaagtaatctacagatgattccaagtatgagagaagatgtccacagattatatgcaaaaactatgacattttatgtaagtgactttagcatccatagatttttggtatccccaggggttctggaaccagtcctctatagataacaagagataactctatttatagtgttctctgttctcccttatagatcatgcaagaataattactttcatagctaactttgtttcttaacatcattcttattttggatttaattctctagagtgacgaagatggctcaaagggtgaatgttctgatgatgactgatcatgatgatgatgataatgagcatggtagcatctgtgctgcactttgtattttttggggtgctatcacatacattacctcatttgatcatttaaaacacatgaacttgaaaaatattaaatgtctgtctatatatacaaaggagaaaaaatatataaactcatcatttaaaaaagtatttccttagttacataatcttgaaatggaaagccttcctaaacatgacatgaaagaaataaatctcaaaacagggattcataatatggaatcaatggataaaccttcagggagtctatggactactgaaattactatggaaatgtgagtgtgtttatataagcatttctggaaagcagattcataatttttatcaggttatccatcgaaggattacatgagtcagaaaaggttaataattgtcaacattcttatggaccaatgaacagattttgtaacatgaacatttaaagagtcttcattaaaataaaaaaacttgccaggcacagtgtctcatgccttaatcctggcactctgggaggctgaggtgggaggatcacttgagcctaggagtttgagaccagccctggcaagataatgagaccctgtctctataaaaaattgaaaaattaaccgggcagggtaccatgtgcctgtagtttccagctactgaggaggctgaggtgggtgggaggattgcttgagactggaggtcgaggctgccactgcattccagtgaagactggatgacagagctaatgtgatttttaaatcatatttaagacttaaatatataaataaactaccacaacaaaaattaaaaaggaaatgatgtaatagggttcttccatttctgaccaaaatggagtagggactagatttactctgctgcttgaaactaccaaaaaatggacaaactgtataaaagaaaaaaaaaaaactgtctttgcagacatgattgtctaggtagagctaaagtggagtaaggcaagtgaggcacacaggcagcaaaatttaaggaggttctcactctgaggtcctggctccatatctgtgtaaaaattctaaatggaatctaaaaaaataaggcactagaattgactttagcaatgttgtaggattgagatcaaaacacaaaaatcatctatatgtctatatacaagcaattaagaaccaaaaattgaaattaaaaaaaaaaatgccatttactatggcataaaaaaagtgacatactttggggaaaaaaaggagaaagatgtgaaagacctgtatactgaaaactaaaaatactgctgagagaaactgacaaagcaatttgtcattgtgttcatggggtggcatactcaatattggtaagatgtaaattctccccaaatgatctgtagattcaatgcagtcccactcaaaattccagcaggttatttttggagaaattgtaaaataaattctaaaatcgacatggaaatgaatattacctagaacagccaaaacaactttgaaaaagaaaagaatacctgacttcaaatcctataaagctacagtaatccacacagtttgctactggcataaagataaataaacagatcaacagaatagtatagagtgcccagggtgtatagacaaagtataaaggccattcagtggagaaaagacagttttttccaacaaatggtgttagaatagttggatattcatatgtgaaaaaaatgaactttgatccatactttacaacatgtacaaaagtaactcaaaatgaaccacagatctaaatgtaaaacccaaagctgtaagacttctagaaaaaaacagagaacacctttgtgagcttgggttaggcaaagatttcttagacacaacactaaaatgcataaaagaacaagctgataatttgaacttcatcaaaatctcaaacttctgttctttaaactgttaagacaattagaaaacaaaccagactggggggaaatacctgcaaatcatatgcctgataaaatacttgtatacacaaaacacaaagaaatctcaaaactcaataatcagaaaacaaataggacaatttaaaaaatggagaaaagatttgaaaagacaatttactgaagaagctatatggatgacaaataagcatgcaaaaaaaggtgctcagtatcattagtcattagggaaaagcaaattaaaaccacaataaaatagcactgcatgtatattagaatggctaatattcaaaagattggccatttctttttttaaatttttttatttatttttattttattattattatactttaagttttagggtacatgtgcacaatgtacaggttagttacatatgtatacatgtgccaggctggtgtgctgcacccattaactcgtcatttagcattaggtatatccctaatgctatccctcccccctccccccaccccacaacaggccccagagtgtgatgttccccttcctgtgtccatgtgttctcactgttcaattcccatctatgagtgagaacatgtggtgtttggttttttgtccttgcgatagtttgctgagaataatgatttccaatctcatccatgtccctacaaagaacatgaactcatcattttttatggcttcatagtattccatggtgtatatgtgccacattttcttaatccagtctatcattgttggacatttgggttggttccaagtctttcctattgtgaatagtgccgcaataaacatatgtgtgcatgtgtctttatagcagcatgatttatagtcctttgggtatatacccagtaatgggatggctgtgtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccaagattggccatttcaaagttggcaagtacactgatatactaatggtgggaatgttaaatgttaaacggcacaatcactttaaaaaatagtctggcagcttcttaagaagtcaaacatacatctgcaatatgatccagcccttctgctcctagaaatttgtcaaagagaaatgaagcatatgtccatacaaagacttgtatgtgaatatttggagcagctttatttgtaatagctaaaacctggttacaaccccaatgtccattgacaggtgaatggataaacaaactgtggcatagccatacaattaaacaacacccaacaatataaagaataaactactgataaatgctaaaacacagatttatcaaagtaattataagtgaaaggagccagataaaaaaagagtacatggtatatacagtttcacttatatacaattctggaaaatgcaaactaatttatagtggttgcctgggataagggtgaggaaggaacagaacacaaaagggcacaaagtaacttttggggatgaaatatgttcattatcttgattgaggcaatagtctcccaggtttataaatgcccaaacttatcagatagtacatttaaatagttcagtttataatatgtcaattatacctcaataaagccattcaccaaaaaaagcaaatgacaaaattgtaatgaaaggggtaattaatcttactatgcagagttcccatgaaatccattaaaaattaataatcgaacagaaaaatgggcaaagaaccattaaagaaaattcacaaaagaactgtgtccaataaaaatatatttaacttcactaaaaattaattagtaataaaaatgcaaattagaaagtgccttttttttttgcctgtttaactgacccattgtacctcaagacattatttcctgaggaatgtaagggtagttagtgtgtactgaagcactatctaaatgttgaaaaagatataacagtataattgtgcaacaacagttgtttaaactacggtgtattcatttaatgaaagggaatttagccactaaaattatgtatagaaatgtaattatcacaatggaaaattgctcatattattcattggaaaaaataatttataaaacaatatagacagtatatacaaaaggacgaccactttttcaagttataggccttggtttcatgaactatgagtctgagatgatgcatataaacaatattaggtatttgatctttatattcatgtactatttcattcaggcactctaaatgaagaccagctcaataataattggtgttctctccctgctagtgagtaccaaaggatattatcaagggagaggacctgcttacactccacccttttagtgatgtgcattcctcaatactaattactgtttttaaacagaagtgtagccatttctctgtagattgttgtggatttgactattatttttcattacacattttgaacttttctccaaaacaatcagaacacttattaccctcaactattcaaagactgcttacagaacaagagaaactttaaagctgtaaaagaaaataagtgctccatgaactggaatttggaatgtttaacattagtaggtgggtttcaggaataaataaataaacaaatgcatatcatgtttcatgatctttgtcttatttgctttttaaaattgtcccttcaacatttaattgtgttttgctgctatgaatggaaaataaaactgggttaattatttaatgacattttttaactccctatattttctctgagattgtgtacctaccaaccatgatttcattttaatatgagtgagcgaacatgcatagaaatggcccagaagcacatacacctacgtaagtaacagttacataggttagtaagatttcagtatttttcattttactctttttgtcaaactattttctaagtattataatatgctaaacatgtattatttttctttcttaaaaatgacatttttaactggaaaaaaaagtaacaaaaagcagagcctaattatttatctctttatttttccaggtattaatatgcctttcggaaggattaaaatggcccaaatggaagcggataacacaaataaatacaaacaattatgaacacttgtttttttcatctaaaggaaattttctatacagaagccaactgattggtattcaaggggtcaaattaaacaccctattttatctttaacacctttagttctgtgaaggcagccacaaaaaaatctgcagaaatattcataaagacttagtttctcagatactagaaacagaagccgttcagaagttcttctgctcttccccctcctccagcctccacaaatacatacatcaacttgtatcagactatatagatttcattgtaaaatattaataggatttaatacatgacttctgatattccttcaagctctatgcttttaacatttcaggggtttctaaaacactttgacataggccacagttggagtataattttgcaattaaataactctttcttcattttgtcattactttttgtgttaatttaactttgcatatttaaaatttagctctactctaacctggtatgtttaaaactcataattttaacagtctcactcccatcttttcctcactttttgaagagctgtcatgtaccatgcactaagcagattctgggaatacagacactggccccacttgaggtttcgaccttctgaaggagaataaattactgcaaggtgctaagtggtatagcagaggaatgcacagatgatgagagcacagagatggcaactacatttgcttaaagaaatgttatatccatcaaaatccttctaaatttacttctaataggctatcatttgggattcaaaattttacaaaattaaaaaattcttaaaatgtttttatgatggaaaatcctttgatttatataataagcttggtgcttttgtgtatgttcttgagttaaacaattatgaaaaaataatgtggttttctcaagagatttttatctttacaggaggaaggacggaggaaataagatattttaatccactgccctttgcatttgaagcaaatgcaaactttgctattattacaatctatgtacttacattattgactttataatgaagtgaacctggaatcacaacatattctttctcttacattatattaacaataaggttcccctttggttcaccgtttaattcctttgttcaagacatttcattatatatagccctgttactttatatggtcatcttactggatacctaatttctttagctataaactattatatttccagttataatatcatccctataagttggtagttctacttagtttcccagcatttagcagttatatagcattctccttctctaacatctgcagtaaatgttcagtacttataattttttttttttttttgtattttatctggcctgacttgttcctccttcagctaatcttgagatactgaggtgatggatccaagaagttctatagacttaacacttcaattctggtagcctgtgtttcagggcctgttagcaattttgtatttccttgacacaccttgtaagtcaattagaactttgaagtattactaataaaactgttcaaaatctatagagtgatgtgtagcagattcaagtctcacagtcaaccaaatgagacagcatctaccagcatctggcaaattcattagctggatataaaaattgaatcaactatctgcaaattccctgcagtacatgctattctgctcttgttggttcctattccattatcaatcatcacacagaatgttatccaactgaaaatgtgtcatacataccctgctacagagaatagctacaatttcccgactgcagcctagttcatgaactctaataacacaggcattactcagagatatggcgggtttggtttcagactactgcaataaagcatatatctcaataaagaaagtcatatgtttttaattttctagtgcttataaaagttatgtttacactatattgtagtctattaagtgtagcattatgtctaaaaaatcaatgcatttaccttaaaaactattttattgctaaaaaatgctaacaatcatctatgtcttcagttaatcataatctttttgctgatggaaggtcttgctttaatgttaataaagggtctgctgactgataaatggggtggttgctgaaggctggggtggctgtggcaatttacacaacaatgaaatttgctgcactgattggctcttactttcacaaaagatttctctgtagcatgtgatgctatttgatagcattttacccacagaaattgtgtcctctcaaaccttgccattgctctaccaactaaatatatggaatttcctaaatctttgttgtcatctcaacaatgttcacagcgtcttcaccaggagtagattctctcaagaatctactttctttgctcatccataaaaaacaactcatccattctagtttaatcatgagattgcagtaattcattcatatcttcaggctctacttctaattctagttctcttgctattttcaccaaatctgcagtcacttccttcattgaagtcttgaagccctcagagtcatccatgggggttggaatacacttcttccaaacttctgttagtgtccatattttgacttcctcttatgaatcatgaatgttcttactggcatttagaaaggtgaatcctttccaggttttcaaggtactttgcccagcttcatcagaggaatcactatctatgtcagctatggacttacgaaatgtatttcttaaatactaagacgtgaaagtcaaaattactccttgatccatgtcttctcctctttagctatgaaactactggagggcatcttcctccattagaaagctgcttcatctccattgaaaatctgtggtttactgtagccaccttcatcaatgatctcagctagatcttctggataacttgctacagcttctagatcatcacttgttgcttcaccttgcactttaatgttatggagacggttaccttccttaaacctcatgaatgagccgctgctagtttcaaacttttctcttgcagctacctcacctctcacagccttcacagactttaagagagttagaggccttgctctagattaggctctggcataagggggtactgtggctggtttcatcttttatccagatcactaaaactttgtccatatcagcaataaggctgttttactttcctgtcatttgtgtgttcactgatgaagaacttttacttcgcattcacaacttggctaactatacggcacaaaagtcttagcctttgccctatctcagctttccccatgccttcctcactgacctcaatcacttctacctttttatttataatgagaaatgtacaattcttcctttcacttgaatacttaaaaggccactgcagggttattaactggcttaatttcaatactgtgtctcagagaatagggaggcctgaagagagggagagaaatgggagaacggctggtgggtggggcagtcagaacactgaaaacatttatcaattaagttcgccatcttatatgggtacagtttgtggtgccccaaagcaattacaatgtaacatcaaaaagcactcaccgcagatcaccataacagacataataatgaaaaggtttgaaatattttgagagctacgaaaatgtgacagagagacaccaagtgagcacacaatgttggaaaaatggcgcccacagactggcttaacatagaattgccacaaaccttcaatttgtagaaaacgcaatatctatgaagcacaataaagcaaacaccagtaaaacgaggtatgcctgtatttatgcttcatgcctcattttatagtttcattttatcctttgataaaaatattgatataaaatagaatatatgctattctaattttacaagcagaacaaaacaagtgcagaaaggtaaattatttgatcagggtcaaatacagagtggtagtattttgtctagaatgccagcgctctcttactccagtctttgttgttgtctattttacatcatatcattcatgcattagtgcaattaaaaacaccactgtaaacattaaaaaaaatgtcttaaagaggaagtcagggctctggtttatgctcaaaactatcaagttaagttttccatatgtcttgagttcttgaatgatataaactttcatatcaaagtacctattatgtgaataatattaaaataggtacttcagcatataaccaagaaacaggtagttttggcatgtcttaaaatgtggcatttctatcttttaatttctcctaccaggctaaaaataaatatttaaaattctgccctactattaggtatattttaatgacataatcttgtataagtatgagaattatgttatctgaatgtgcttttgaactattcataagtattacaaatgaatgccatatagaacgtagaaaacaaatgtatttctacatttgtagatgtatcgtatgtacatcgtattgcaaatgaatacatacaaatagctatctccaatatagaaaaccactacatcgtatctatattgtacagaaaactgtggatattaaatttatttctactagacattatctgatttcaaaaatattgtaaaaggagttatattaaaatttaatgaggccaggcatggtggctcacgcctgtaatcccagcactttgggaggccaaggtgggcagatcacttgagaccaggcctaggattgtctcaaacatggcaaaaccctgtttctacaaaaaatacacacacgaaattagtcgagtatcctgtggtcccagctactcgggaggctgaggtgggaggactgcttgaacccaggaggttgaggccgcagtgagctgtgattgtgctactgcactccagcttgggtgacagagcagagactgtgtctcaagaaaaaaaaaaaattagtgctatatactaaagaatatttgtattttaaactatattgagaacataatggcttattacatcataattatgttactcctcaaagttttatttttatgtatgtatgtatgtatgtatgtatgtatgtatgtatacatgtatgtatgtagagatgaggtctcactatgttgctcaggctggtctcaaactcctggcctcaagcgatcctcctgcctcagcctcccaaagtgttgagattacaagtgtgagccaccacacccagccaccccccacatttttaagggagtgaactattaataatactagataagcaaacttcctttcttaaggggttctcctaaatgttgaaattgaaaaccaacaacacattttaccataggaatatttagctactttttaaatttacttcatgatcaggaaatgcaaagactaaataagtgcctaagacagatagcttaatgcactgagaacatggactctggagtcagcttagacaaaatggtggctttacaccaactgtgttactttaggaaaattattgttttctctgtgcctccgtttcatcatctgcaaaatgaggataataatgggacctacaatgaagagttttagaaggatggtatgagataatatatgtaaaatgctcataagattggtagacacagtaaatgcttgataaatgttagctactactaccactgttattagccccaaatttactgatgatgcctctcagcatatatttttataaaatttaaggaaaaaatgctattctataggatttgtaattgttaatgccaacatttattcatttattgcatattagtaacatgccaggtactatgttagacatatggcattctaaatatcacacgcttctaggcagtgagcaacttaaataacaaattttataggaaactaaaggtacatgttgccctgaactctggtaaagtgtgccacaatataaaaaataagtttgtcaacaatgacaacgtaggctatcattaattaatatgaattgtgttaataaaatcatgtcagtagtagaaactgctttttggtttaaatttcttttagaaatgtaatcaactacttaggaagtacaaaggactagaaaaaagaatggtaatctgagtctgattcctgtgtttcataacacagctcaacttgacacacaataggtgcttaataaagatttgtcttgtctaagatactatgactatgtgtcctctgaaccagagttgatactctgttattaactctggttaatatactctggttaataaactcagtattaactctggttcagaggagacattgccacctagcgaaaaatcagcctcattacctagaattatcagacaatgctgagaacttctcaaattagacttgactccactgacttgactccactgaaaacactacatgcatatttattatgtgtcagtattcagggtaggtactagtaggaaaaagatgaacaagcttccatctttgcttcttacaacgtatagaaaatacaaggaaaccacatactccacagagaaacatagaaaaaactgtactgtagaaaaaacaaggtttgattattagacatttagaaactagtatttcaagaaatttgctgaaaaggaaatttagtgtagcaaataagagcatggactccaggagcaaactgcattgatttaaagccatggctcctgtaaagcgaggataacagcccctatgtcataagattattgcagaaacttaaatatatgtaaggtaaaatgcttaaaacagaaccaggaacaaacaaaatgctatgtaagtatttactaaaattattattaaatctagaacaatatcctagagactgaggtgaatattgattaataacaacacattaactgaagtctagcttcataaatttaattcagtagaagccgtttctctgactagtactctgttattatgggaatcctaaaagtacattatttgtggtactctgtgactaaattttgtattactggatgattaaccctttcaacatcaggcaaataaaactgccttctgaaagtaaaaatcatatttcttaccaaaaaaagcaaaaagtcagtagaatgaaagacccaaaagaccacaacctgaacatatgtttaccagggaaagatgcttgctaactcttcacagattttgctagaactgaaagatggatgatacatttagttaccactgtggtctcattcacaacttgtttagcttataaaaaaaaataagcttgctccattttcctggaaaattatctgataattttttttaaacaccacttaaaaatcccttaagtcttttgtgttttttgaattttatactattaaaatatttatgtaaagccatatgtaaactttattttcaaccaaaaaattatgagcaaaatattcctgtattaaaaaataaaacataagacaaaactctaataggttggtaataaatattatacttttcttatggatctataccattcacaagaactctgctcaatcttagatggcttaagattacttaacttcttcctaagcttcctctttttaaaaatagcaacgagttgggaaaatgtgttgaaacattttttagttttaatttgtttgtaaaggtgtgtttgcatatcaaaaattgtgtttgtgatatattgcacaaataatttaaatttaatgtgtctactatttgaatatttagatttctaaaatgctcatggaaatccttcctcttgcacattaagatagtgtggaaataacattatgtttttaattttatgcatttatattctaataaattgacctggaaagaaacatactttaataaataaaagactgaccaacagagtaaaagagaggagaaaaaactcttcaactgctttccatatagagatgcttattagcatattaaaacagaaattcttacatatagtcaagcatatattggttggatgggcataacaacccattttatcttttgtttcaatattgtgcttatcaatttacctagtactttcacagtcatggtctcatagtatcttcacaaatacctctcttaggtaggacaggtattagtactgtagtaccttttcatagataagaaaatggagcttcaggaaggcaagaagcttgtgcaaggtcactagagtaacagaatggagcctaaaccccatttttttagactcctaaaatgcttagctctttctcctactaggcctctagaatggacttctttgcttactgcctaaaaaccaaactggcaaacctaactatcctgggctactctgatgataaaatcctgtcagtgacaaaaaataaattgctttaagaaaagatagagtgcaactttaatgtgtatgtgtagtgaaaatttcaaaggcataaaaagcaaattagaaattgaatgaagactactgtaaaacctcttaagagtctgaggaaataactgtgctgcctatttcctgtataacagttccaaatataaagtactttggtataactcttcatttatgtgaagatttagagtgggtacaaagagagaactgtttcaggatacatggtgaaactagacaccagatttggacattgaatgatttgaggaatccatctattttttcctataatcaggcagtgtttatctttgctaatgtctgcttgtaatagtaaatggtactgtgttgcttggcaattctaccattactaacagtgttctataaatctgagtatgcattgcagaaatgatttcttctctataaaattctttaaaataagattacattttgactttacacattattttctagcataatttaccctggaaggcataatataatccacactgtgatcaagaacttcagatttctaacttaattgcctaattacttagtatttatcacaaccattaatcaattcaatctatattaacttaatacacttaactttccataagcaaatcaaagaaactaacaaagacttttcatttttgtacaatactatatgaagaaaatagaaatgcaattttgagaatgacagcactaatagtataatatagaagagtggaatcctaatttcaggatagaaattaaagaaatatatgaaaaccagcatatatccaaagaattcttagaataccatactgtccctgaaaaataatgtatccacactttttatttccttattatttctcagaatgatagaatagtgtaattgcggacacgaaagacattagatttctaattccaggtgatgttttcactgatgtgattttccccctactttttatgttaagaaactctcaaaactacaatttattaaaactatgtgctttagtaacaacacaggataaaatattaactcaacagtcaactgaaaacatcaaagatctgtattccctaagttttatttaccttttaaatttagttaacatattccaaataatttttaggtgaattctatttacttaaattgatttacaaagaaacttgtggctagctttctgtgattccaacataagggcacaattattatgtgtacttttgtcaacatttgaattccagacagattcctggtttagtctaaatgtaaaggttactctaaaaattctttacttatcaagtggtagacttaccatggaaatcgtaaatatacagaagaattggctcattttgcccaaatgcacagaatgcaaccatattttcaaatggatgataagaaatgtctcgaatgggtgacttgaatggcaagtcagaatacatggctacttgttctcctaaataaaaagagagattcaaaaatgtatatcagagcatatctgtatcgataaatcttctcacaagattattctgccatttattagaaaatatttatagcaatgatgctcacattatttatgtgaaaacctcaaatatttaaaaatgtttgagtaacaatgtattaaattatctttattttacattccactgaccctcctccttctactttctacctcttcaatgaggttttcaaggcacaaaataaagacaaagggcacagacggaagtagagaggtatatgactctaagattggagattggacagagctaagcaaactccaaatgacagagaactctgggtagaactacaggagaaattacaggactctaaaactaaagaaactctagttgggtgagctttggtgaaggattaacttttccattttttttttcccagatgctgtttgaggtacccatttgcttgaaagatacctatgactatggcctaaaagatgtctaaagtagagatctgtggaatccaggaaaatcagtcaggagtcaaaaagcaaagaatctagattcatttattgaaggcgagacttgttgctactgaattgatgctaaagcatcaaaacacggtacaggaaacaaacaatcaaacaaaaacctaagttacctgactagtcaaaatgcctaacagaaagaataaaaaaaaaacaaggaaaaaatcaaatactgttcattaaagaaattttaaagttagttttatgaaactctctcaatttcttattaaaaacattcatgtagctttagcttttcttttgaaaagcaaaggtgaggcacaagtgagcttcccaatgtaattgtttattggaaaaaaactgaactgcagtatttcaggcaacttgctatttaagtttcagacatcaaaactttcacaggtatgtttccgttactaatgaaaatatagatgtttaacaatttgtctacctaatcatattccaaattcagcttgtaacattttgtactttgtgttagcctccattaaacgcttttctaagatcagcaatgtctcattataggccatgaaagaacaaaccttgaattataatgtgaaattctaaatccataaagatattaaagcaatagagaacaaaatttaatacaagtttagactgtagctgagttcctttaaaggctttctaatcttaaaaaacataattgaaaacccaaaatcagaatttccttgaaaattattccataaaatggtagaattttcacacttcttcaaacccctgtacctccccaaatgatttttaaagttcaataaacattcacctgtttctgggttccaaacatacactataccatcctcacttccagcaaacagaaaagtcccacatggagtcaaagtactatgaatcttctcccgataatttgctgctcctacaaacttccttgctactaatctacaagcaaaaaagattttacaaatgtaactgtcttaatcatgtaaatgactggtggtataaaatcttttctcttaaatacttaatttccattcaacaaacattttttgagaatctgccatatgggagacattctataatataatggatgcagaataaaggagagctagtcccaagagcccagggagtttataatttagcaagagaggagaaacatgtcaacgtaaaatagaaggtggatgtagaacatactgcaaaagaaaaacagaagagttcttttcaaacttggacaagagaaattaattctagctatagagcaagagagactactttatggaagtagcatttgagctggttactaaactaatggatagaatttttatactcatatattcttctgatgaatttttaaaataatacaaggaatatttgatctctgaaaaaaaattagataaaacatattattaaaccatctgctaaatatggtacatagccttccatattttttcactcacgaaaaaatagtaaacaccatttcagcacacactttgtgccaggtaagtattattatcatctctaacatcaaacaaaagtgcactagaagtccatgttgattttcccagaacactgcttccacctttttcaggaaggatatttccctacatttgcgattatttggaaataaacaaaaaaacaaggacatataaatcaaaagccctctcctgtagttatatcatattatactaatgctgtaacagtatcatagtgataatatcagtatcaatcaatatcattgttgaaggtagaagtttcttttttttaattgtgaaaataaaagcaactaactacatttcagcctcagaactactcacattttgggctggataattgttttagggggactgtcctatgggctgtaggatgcttagcaatattttttatctcgactcattagatactagaagcaacataaaaaaaaaaaatctccagatactgccagatgttccttggtgagtgtggggacactgcttagttgagaaccactaccgaattttataaatataatttaattcattacttactctgtgagtacttatcctgtcaacactgaaatatacttacatccggagatccataattctcaaagtactgtctttggtatggattaacaaacgttttccattgggatgaatctccaaataacttattggaattcccttaaactcagtttctttaatttcctaaaatgattaaaaaaaatactactactgaaaagtttgtctaatgttaaacttttttgggggtacaaaattaatcttaaaatatcatttccaattccactgtataggatgctttaaaattgttagcaaaaggattctgagtaacgtcagtttagggctgaaaataaagctgatgaattgtatttctgtgttgttatgcaatgtgcaaatgcacatttaattagtatgtgtttttgtagtatgttcactttcccaaaatttggtcagtcccaaacaagaagtacttccaacaaacacatcttgtaacattacattttttgtttaaaatcatgtaagaagcttccaatttttataaattcaaaaccacatgtagaaataattttcaagtttctattcttatttagataagaatttctaacaacagaatgaactgctttttcaacagatctgatagactcaacagatttaactaaaattcatggaaattatttttcacttagggtgtcttttttcaactactatcataattatattatgaaaaattgaagaaaaaggtataatatgttaggcagaaactgaatcaatttatatagaacaaattcaagtttaatgattcatttgtatttttaaataaaaagtaaaaaatgtacactaacaaaactgcttaacatacaagctgtcttaaaaacactccagcccccaaatgaaagaacttattcatttgtttctattcggcaaatttcaaatgaaacaattattgtgattaaatgacagatcttcataataaccgcataactctgaaagacaccagtgttgataaaatactgagaacactgtttttagagatataattggaccaaggaaaaaggatataataggaaatataaattattacttatcgatggtaatataacatacatctcattttagcataaatgtcacccaatggattactgaatgccacagtgcaaatggggtataaaaaagtgaaattaacacctggccaaaattttaaatcttcactaagtcgttatatcatcagtcagccatcaggagggtgtgctaattaattattgataactaagaaaaactgttaattttttgaaatgagagaacagaatgtcctgacatcctatcttaaagtcatgtgattggatttttccaacttctttaattaaatcccaaaatataaaatatgattttataccttatttatagtccagtggtgcactgaatgttccaaatcattaatcttgacataggtattccaaacaacaatcacccctgtacaatctcctgaatacatatgatgacctatttaaaaaaataagatcactcacttatgaatgtcacacagagttagaaacaaataataggaaatcgggggaaactataccccagtaaaacagtcaaagaattgaagggctattaaaaggtatttcagtttaaaaaagccaaaaatcaaaatgtaactcacaaacaaaccccaattatctttaaatgaattctttactcttttaaattatttttgatgacttctttccctttttcacttacctgaatttaactataaaaagaaatgagcctctcagtacatgtgtatatggcttatattccaaagccaaataatttgaaccatccgacatgtaacattatttctcatctttattaacccataaatctgttttggattcctagaaaaatacctatattctaatatgcaccagtttaacatcaattctttggagtcaaataatcttaaaattgaaagacctcagagaccattaagttcaacttcatacccactcaggaatatctcaaacaccaccactaacagatggctgttcagcaactgtgaattcagtattttataaaacagctattcaactggtgaactgcttcctgtattaaaatattctttctaattctgaacaaagaaaatctatcttctacagctttggcccacctctacccactggagtaacatggaccaatttccttttttttttttttttgcacatttggatatcgtatggccaaatagttgaagaaagtctttatgtctcttttataatctcaactactgctattatgacagagttagttttcagatacctttctattcagagtctttcctgaatatgttccaaatttattaacatccctacagctgaactgagtaaatcagcagtattatccttttgatctggatcccataccaattaattatagcgctagcctacatgcccagtctctgaaattatgtaaaaagtgactatttaatagatacaataaatttcttcattctttcagataataaaatgatttacgttttacatctttaaaacatactacattattcttttttttgagatggagtctcactctgtcgcccaggctggagtgcagtggcgcgatctcagcttactgcaacctctacctccagggttcaagcgattctcctgtcccagcctcccaagtagctgggactacaggtgcatgccaccacacccggctaattttttgtatttttagtagagatggtgtttcaccgtgttagccaggatggtcttgatctcctgaccttgtgatcaacccacctcagcctcccaaagtgctgggattacaggcacgaaccaccgcgcccggccaccatattattcttatatcaagataaaactttaaataattgcaaatttcccttctatatgtttgcaaattttaaggttcttgaagaaaaagtaagaatgataatcaccagttcaaagaaatatatttatgcaatttggcacatgactggttgttatagcaaagattaattgaatctaaatgtttaagaatttaaaaacttaaaaattacaaacagaagtcccttagtgtcatatctatcatatgacctgcaaaataagcataaacctaaatatgcgcaatcatcagtacataaccctctcaagcctaaataactattattctggtaaaaaaaaattcttcacatagctggtcttcattcatagtctctgacataccttcagtatcaaaacaaagtgagttgataaaacttttgtgaacatcaaactgtcggaccaatatggcagaatcttctctcatctcaactttccatatccgtatcatggaatcatagcatcctgtaactactagctctcttacagctggatggaatttagccgtgtaaacaaaagaaggatgaggtaaaactctgaaagtatttgtattgtttatttcatttttccatatcctggaaaaggataagaagttacatattgcttctgaaaagcagaagtttcttttaacagtttttctaagaaccaacacagccaatgaaccttaagcaagcaagtgacaacgaccaatggtaaaccaagttttaaaacaatgaaaaatataatgatgatctcatatttgatgactggaattttcacatgtgacaaagttatttgttatagttattatccagcatattatatccactaattgtaatctatactataaaattaataactttttaaaacctacctattttgctgttggttaaacacacattgaacagttggtaaaatattgcatttagtacaatatacataaaaaatatatagggagaaactttaatgatttcccatttaggttgtgtataccacttttacaaagtgtttattaatgggggtttagagaatagaatagtctattaacttttatatttgtaatttcaaagcctagatagtaaaaatgaagatctcaaagatttaagagatactaaaattattatattttgaattctcaagtaaaataagattaaaataattatgacattttgatagaaaagactatcctacattaagcacgttctttttgtttaacactcattatcctgtcctctaaataatggctaactaaaaaaaattaagattattatcactgctacagtcttgacaaatgagtaaacccttaagggttaacctcttagatactctgcatttctaacaatgtataaaactaggtgaaatctaccaatatacaggtgctatataagtgtgaagcattggatttttaaatatattttgttaaattatcaaaattagaagaacatattaattttaaatatgggatttgtattcatccttttaattactgcttgaaaactaaagcaaattgagtctgttacaagattactgataagagaaaaaaaaacagtttctattcaagaaaaatattctatgagtttcctcagcagctgcttacaatataggatatgatcttcaattactaagaatccaaactaataatagaggaagtgaaagaacatgttttcgagtaaaaataaagcccatgaatgaatcaattgcacaagcatttttaccacagtgtattctcaataagcatatttatatgaaatatgatgcctattaaaagaaaaaaccactaattttgggaaaatattaaaaagatagatgaaaaactcagttgtttggtaataaatcttagtagcattatttaaaatactatataacaggcagaaatgaagcaaatacatcttcaaaacagctcaatataattaaaacagacataatattaaaaaaataaaagtaaagctttttgtgtaaaaactgaactggaatcaatgatggtttctgttacccaggccatggtagaatctgagattaaaataaatatataaatgggtttggggaaaaaaaatcagaccagatcatagagaacaaagaaatacaaatttgtaaagactgaatgaacacacacaaaaattactagatttgggaaagaaaaaacataaagttaagccatatgtttgagaaaagggaatagtgggcacatataggcctgtgtgggagccattacatatggaaaagcctctctgactgtattagaagttgttgatttgagaaaaacacagattattccagggataactaaagaagggtatttaggataaacccatatggcagaaagctaatcaagtgggaaatacttaggagacactaacaataatatgtgtcagggatcctcaggaataaagaaggagaagacatggacagaaattcatacttctgccacttgtgagcatttgcaattctaattctctttctttggacaacagctcctttattacaagtattccttacctctttcaaaactctccttgtcattttgatgctagccacatgcttctcttttcactcagttaatgctttcacaatactattttaatgatgtaaagagtcctaaattagtatcagttttaaagataaataaggaaaaaatgtgtgctttagcataatatactacatattgtgtgcagaaacccaagatagcttcaagaaataatagaatttgggctggattttaaataataactacaaacctatgagagctcacaaaaggcacttaatttttgttgaatgaataagttattcaggaagggtaggagaaggtcatttaagtataggaaaagtaggtaagtttcaaagggcaggaagatgccaaagaagataagatgctagggtgtttcaaaagattacgtgggtaaagcaaagggtacaagggaagcgcatgagaaaagaatgttgggtcaatgaggaacatgcctgttaggccatgctaaggaactggaaaatttttcaatgggcaatgggtaaagtcttttaaaaaattaaggcattatgaaagatagttatggaaagataattttagcacagcagagacagaggacttagagactgaacactgaggtcaatagcaacaatttaagcaaagagtaatagggcttgaattaaagcaaacgcaatagagaggacgtgacaaaactgtgagccttttaggagggagaattggcagactttagtgctagttagatgtgaaagaaatgatgggaaagaaagaagagatgaacaccactctgagttttcagcttgggagatggtggataaggatgccattaaaatatatgtaagagaattaaaagaggaaaacaaaatttaaggaggtgggtaagtttggttttggatttgaggtggcaatgggccattcaaatggaaacgtgtaataggaagtcaaattcataaaaaaggtgtgcgctagaagtcattagcatatcagcaagagtcaaagctgggaaaggtaagagaaactaggataagcatataaaaccaggagatgatcagctaaaggatcctggggataaaacatatagacgatcggcagaggaaaataaatcagagaaagacaatggatagaactggtcagagtaataaaaagagaagagaagaggttgtcaatgaaaactatgaattcaaaatatttcaagactggtcaataatcaattactacagtgaaggcaagcagagcaggagttaaactgtccaaatggatttaaaaatagcaagaaactgccaacctctgaagaaagaagtttatgtagcatggtgggaaagaaagccagaataactgggctgaagtaaagacagtatgtgtagaatactcctgatggtgtagaaaaagaaaaataatgggctagtctagaaggcaggaagaactgaaaatgatgtttttaagataaggcaatttgagcatatttcttttttctttttgaggcagagtctcaatctgtcacccaggctggagtgcaatggcgcaatctcggctcactgcaacctccacctcccagttcaagtgattctcttgcctcagcctctgaagtagctgggactacagatgcagaccaccacacccggcttatttttgtatttttaatagagacagggtttcgccatgttggccaggctgatctcgaactcctgacctccagtgatctgcccacctcggcttcccaaagtgctgggattacaggcataagccactgcgcccggcccatttgagcatatttctaagatgagaggacacaatcaatagagagaaagatattaatcagactagtagatgtaatacaaattttcagggactgagatgaaaagtacaggtcaaatagcctttaaaacgtcagtcacgtgcctctttgttaaaagagatggacagagattaaaaatggacatatctatggatattaggagggaaatcagagggaaatatacgaagatcatgtctgactaaatttcatctaaattgaagatagtcatctaatgaagtgggaagactgtgatttactgtagagaatgttcatggtaagtttggatctgctgccagaggaaaaagaaaaggaagctgagtaaagtaaaaggattcctcagcagagatgacagcttaggtgacattaagacttacaaatccaaagtcacccctcagcaaagttacatatttttctctagtatggcctggcattggacagaatggctgtgctaaaagaacagatcagatagtttcttgaggatattgtcaaaaaggagtaatagtaggttcccagcatgaccaagaaggaagtcaattgttactaattctcatctttttcatttaaataaaaactaaccaataatggtaacatcttgattagatattttatacagaaaaggaggttggcaagatcagtagaagaagtggtctgaacactaaaagtaacacgaagtgttaagagagtagaaggcagaagtaaatgacaatgaattcagcatggatctcaactgtttacatgtcagtttcgtagtgtgtggagagaataatgtcttacctaatagctgtaagaatcaaattaagtgatgtatctaaaagcaccctgaaaactaacagtatttttagaacacattcaaggtagaacaagcaactaaaaaaagtataaatgaaacttttaaagttagcttttaaaatgttttattgtgatacttattaaattgaaaagggataaattatttttaagattgacattctgaaaaatgtaaatgtttaaccaatctataaaactgttaaaatataaggtacatatttgtttcctctactgtgatatactgagcaccactggattctaccctctgcaaatccagccaatagtgaagacagtatccctgccaccaagagcttatgctctaggaaaaaatctcaagtgtttaataacccctaaccccatctcaaagcattaatcagtttacataatgatcatttaaagatggtgaggactagaaatattatatgctacataaataaaagacatttaagaaaaatgtctttaaaaagtgttactataatttatggaatcagtctgcatgatgcatatttatgacagtcccttcttgggaaaatacgactggagcataagagtagttacatcagtttatattctctttgctttccttgacagcaaacagcatgcacataagtacttctcaaggatactaacctggcagtgccatcagatgatgaagtaaggatgtagtgatcatcttttgaccaggaaagatcataaatgatattgaggtggccacacaattctctcatgaaacgtccagaaggaatttcatatactaatgaaaatatttagaaattaggtttccagacagaagatccttaatccaataatatacaaatatataatttaatattatttagacataagcagtctataacaaaattataaccaaagacatttgcagcacagagaaaatttcaaaatttacttaagaatagtttttcttttgctttacacaaaaattcacatgcaaaattttcagttataattttgctacaattatcaattattttcatctctttaaagaaatcccctaagaatctttaataataaatttatatcagttgaataataacatttacattgcaattcacttatattctataatttaggctttcattattatttcacctgaaaatcaactaaatgccaaccaaaaatttaattatttgaagtaaggagaaatttaaattgtgctattgtcaaaagtaaattttaatactaaaatgaacagggatagtaatcagggatagtatgggaattaacaatgactcaatcagacacacaaagcactgtggtattttactatatgtttaaacatacaatgaaatctaagatagtaacacggaaaaacaaagtttccaagtctctgcttccatctagtggtaaaaatcaattgccctttaaaatacttagcagttcagaaataacagcagtccccccttatgtgcagtttcaccttctgtggtttcagttacccgcagtcaaccatggtctgaaaatatcaaatggaaaattccagaaataaataattcctaagttttaaaatgcacatcattctgagtagtgttatgaaatctcatgccatttagctccatgtctccagcatgtgaattatcctgtgttcaatgtatccatgctatagatgctgtctatcagaaacttagtagctgtctcagttatcagactggttgtcacccagtgcttttgttcaagtaacccttattttacttaacggtcacaaggtgcaagagtaatcatgttggcaattggcatatgccaaagggaaatgataaagtacttcctttgactgaaaaggtgaaagttcttgatttaaaaaggaaagaaaaaaaaatcatatgttgaggttgctaggatctacagtaaaaatcttctatccgtgaaattgtgaagaacgaaaaagaggtttgtgctagttttgctgtcacacctcaaacgacaaaagtaatggcctttagtgcatggtaagtgttttgttaagatggaaaagatataaatctgtgggtggaaagcatgagcatacatgtgtttctactgatggcaatcgggttcagtactacttgaggtttcaggcttccactgagggtcttagaacatataccctatggaaaaagagggactactgtacttgtggaatagcaaagtaagaatcttagaaaaaatctcctccccacagaagcaacaagaacactggcaaaaactggcaaaaatcaacattctcagaactctgaaaattaagcaaagcttacaaaaatttgaagagtatttaagaaaaatggctgaatttggtaagaacattgagctttacggtgttttaacttgctatgttctcattcctgtctcaaactttaaaggagccttaaaaaccaataaaaatcaagagactggttggggcagaacaggtctgatgctccctaaaagccccatccccaaagacttctcactatttgacagtctggccctccaggaaagatccactgtcagggcctgcctttatttgacctggctcacagcatgctctgggaggacagccctaaccctaaggtgcatgtcaaaacaacccgtggcatcatttaatatcacagctgcaagtgaggctaagaagaggctcaccaaagaacttaaaataaaaacaaaaaacaaaatgaaacaaaacaaaacaaaaaaccgggcatgagatgtccataggggacactgataaactccaaaatattcctgggtatctagaaggattcccatccatgtatgtgaagggaatatgcacaaccaagaaagacctgacaggctttacttctcactcgggctgacgtgaggaggctcaggacaaacagaaagtaaagctaaggcagagctgtagattgtgtaccgaagcattgaaggtataccccaacacacacagagtctcttggcaaagaccagtagacctatccactcaagtatttaaaaatctctgtctaaccacaacggtggtctctgtctgaccacgaacttaaccgagcacagacatcaatggcaacacatgacagacagtaaagactacagaattagtccaaaatcacaaagctaactgcaaaaataataaatcttgggtgggcgtgaggggagaaaggagggcatctgatttccagagttgccacactgcattattaaaacatccagttttcaatacaaaattatgagaaatggaaaaaacaggaaagagtggcccatacacaggggaaaaaagtcatccacatagaaactgaggaagcccagacgctgggctttctcaacaaagactttcaatccactattataaatatattccaagatctaaagaaaactatatctaaagaattaaagtgtgaaaaggatttcccaccaaaaaagagagtatcaataaagaaatagatatgattaaaaaaaaagtccaactagaaattttacagttgaaaagtacaataactgaaataaataattcactagaggggctcaaaagcagatctaaactgaaagaattactaaatttgacaacaggtcaactgagattatccagtctgaaaaaagcagaaaaagaatgaagaaaaatagaaaagtttcagagacttgtgggacaccaccaagagtaccaacacaggcataacgggactcccagaagaagaaagagaaaagggccaaacagaacatttcaagaaataatgactgaatacatctctaatttgtgaaaaacactgatctgcatattcaacaagttaaaggaattccaagtagacacatcataatcaaatagtcaaaaaccaaagacaaagattcctcttcctcctctatttttgagatttaagcaatatctcaatctacatagcattttaaagcaagtttatttaagcataaagtaacatatttatcacagaagcttttaaaacataaaatcggaataaaataattctttcactatccaaaagaaataaattactattaataacttaggagcatttcctaagaaccttttttccctctacatatgggtttttggtgaattttaaaaatagcatagtggtaatcaaacgacacaagtgattttttatttttaaaatttattactatttcatggggagcaatatctacttaataaatgccaatcaagtcaattatgagtccctgattaaaaaaaagggaatcaaccaattaatagcaaactgtgttaagctgaggaaagttcaataagatctagtgtttagggcagatgcccacaaggagctggctacttctgcagaggagagctggttttattattgagtcagaagtaaaggagagagtatttaatgcttctaagtctagaacagtatgataatgctcactttagaatgtctctaaagcaacagaaataattgcttggcctctctgctgacttctctatcataatgagaagttttcatctaggtactcttgagtcaattattggtattccactacacagcaaatctggaggcttttgtaactcaaatcatcactgctatcaactagccacattggactaatgttccccatgagatttattcatccttgtttccaaatttctatatttaaaatacaaaatgtttacaaaaatcctcctgcatgttttaaaaataaatttaccatctttcatttgatcaatctcattctacttacgaacagttactgtatagaaaagtgtaaaattattacaaaagaactttctttgtttgaagaaatccgttttctttaatttagtagtacaggggattactcaagttaagatttccatgaatttaaaaaaactaaagaatgtcctccacgtggactacaatcagattaaacaggtaggattattactcacaaataattggatatccatcccggctggcacaagctgctgctaatattcttccattgtgggagaaatcaagacaaaaacatcctcgttctcctgcatttagtgagaagaggtgtttgtttgggatacggcaagcctaaaaaacatacgtttaaaaaatataaattagcaaacattaaaacgcgaaggctagtttttaatttcaattactgtagttcttttaagtccttttatgatgcagagaaagagaaaaacaagtacgcagaatggtgaaaaaccatagtaaattgctttgtaaaaagagaatcagtgtccatgaaatttttaaagtgggtttgttcttcatgtttaagtagtacttaattcacctaaatatgaatagaaaaatttcaatatctgatactctaaagccatcactgccacactgcttctatatagctactaaaagaatgtatgtcacagccttattctatgacagcactagtaagtcacttttgttaaagtcacaagctttttttaagaccacaagtacctatggggcctagcttaagccagaatgtatgaatgcttattctctctttgcctatcttaaaataatcaccttttgtggctgccttccaaaatgtattttcaaagtaatcaatcggcccttattggtctctcattcattattacaatttcttcaaaattttaatgttttcaccctcttctaccagatgaagcccaaattttctgggtattaatgtctactgtagaaaataccagttacgtttatttatcctaattctatctcttgcaaccttcagtgagccttagttcttctgtttcttataattcaaaaagttgaagtaaacatatactgggctcttactatatgtcatgaaagttgtactttattacaaaggtctttgaatatattcatcacagccaccctatgagtagctattactagctaagagtaaccattattagctctatatggctaagagggattattcaaagggtcaagcctagcttaatggacctactcaaagactgttacttcaagggcatgctttctagacaggtaccaggtttttcacaaatagtaccaagatctagcagttcctctggagacagcattatgaccagctactaggaatgtgaaaaattcaaaagaatttgttaagtgtcaatcatgtaccagactccatgctccccatcctttctctgcattctccagactccatgctacccatcttttctctgcatcctccaaccacataattaagaaaagggagaggagggtaacaaggtaacaaaaactgaaagaaatgtcaggaggctttataaccacttgctgctgctcctagagtaggaagtgtaattaaggaaaactctgtgcccaatcacctaggctgaaaatgaaaacattgaacccactatcatgttctttgtattctcagggtttgactctgtgccctatccacaacagacactcaatgaaagtctgataacaacaataaaggtcctcaaaagccttgactgtttctcctcctttactaccttgtcagtcactaaatcatgctggttcctactttctgtctctcgtattcattagaccctcatcacctcacacatcaatgactgccatctaattctgatgttactacttcaagatctccccatgccactgcctgcattaattcatcctcaaatacaattgttatttttctcactcacccgaaaaccttccattattcctcacatccctcacaatcaagtattaggctaccatttgagacactccacaatgtgggcctcatccagtacactactttatctcctcttttacaaactctggtttccaaccagctaagcttttgagtgcctaatgaatacaacaggtcctttcccacttatttgcaactttgccttcatatgaaatacccgcccttgtccctccttcactcacccctaccttgagcatcctagtctatctcaagctccactgttgaatgagcccttcttccaccattgtagttcagtcttcatatctgcaattctcaaatgtttttagtttcgagatgctttacattcttggaacatttttttggaggctatttggagttttcataaaaataaaataaaagtaacttgctaactttaaatgtctagctgaataaaatctagattttcgtaagtgcctctgctctcttgtgatatcacgttatttagcctctagaaaatgctagtacatacttgtaagagaatgaatctgaatgagactagtaacaccttagaatcattatgaaaagaagttgacttcaagaaccccctgaaagggactcagaactcccagaggtctccaaactacattttgagaactgctgatctgtacaatcatctttatacctacatttcctcatttcatcaagacttctctgaagcatatctgaaaataaacaacaatgtaactgctttcttttcccacctaacttggaagttccccaagggcataatctaagtgttattctctccatatcatgcttaaagtattctaactcaaagtgattttaaaatgtatctgtaaaatcagcctcaaaaagaaagtcaaatgtgatataaaatatagaaaatgaagatgaataagtaagaatagtaagctcttatttctacattagatgtttgaataaattaagattttggataaatttcatctggtagcagctcatatgcataaaataaaccacttcattctttataaaaacaagtaaaacattgcaaaattgtatcagcaatgcttcttgccactgcataaaatgctaatctagtaagaacactttagtaaaagcttaaattctgctcagcttgtggcagaagtatatacatgtacatatctctatcaaagtgtgattcaggaagaagccaggtgctgtgaagaatttcatgaatccataaacattaagagatatacatcttacagacatcaaaaaatttttttttaaatttttaattctttttctttttaaagagatgggatctcattctgtcatccaggcttgagtgcagtggcagaatcatagctcactgcagccttgaattcctgggttcaatcaatcttccttcctcagcctcccaagtagctgggactacaggtgcatgccaccatgcccacctaattaaaaaaattttttttaaaagaatgggtcttgctggccgggcacggtggctcacgcctgtaatcccagtactttgggaggctgaggcaggcggatcacgaggtcaggagatcgagaccatcctggcaaacatggtgaaaccccatctctactaaaaatacaaaaaattagccaggcgtggtggcagacgcctgtagtcccagctactccggaggctgaggcagaagaatggcatgaacccgggaggtggagcttgcagtgagccgagattgcaccactgcactccagcctgggcgacagagcaagtctccgtctcaaaaaaaaaacaaaaagagaatgggtcttgctacattgcccaggctaaaaatctatgttatctgactgctgttataggctgaattgtgtcctctctcctcccactcacacccccaccccttgtcacccaaatgaatatgctaaagctctaacccctaacacctcagaatgtaacagtatttggagacatggtctttaaaaaggtaattacattaaaatgaaataattatggaagggtcctaatccaatagggggagagacaacaggggcgtgcatgcacaaagatcatgtgaagaggcagcaagagggcagccaactgtaagccaaggagaagcctcagaagaaatcaacccagtcatcaccttgatctttgctatgcactgaatgctatgtcctctcaaaaactgtatgttaaagctgtaatcccctatgtgatagtatttagatgtgggggtctttgggaggtaatttggtcctgagagtgagaagctcatgaatcagattcgtgcccttataagaaaagacgcgagaaaggtgatctctctctccaccatgtgagaatatagtgaagaggaggcgggctccaagtcaaaaagtggaccctcaccaggaactaggctggctagcatcttgatcttggacttctcggcctccagaactgtgagaaataaatgtctgctgtttaagccacccagtcagtggtattttgttatagcagcccaagctaatacaattgcccaagtgcccaaagaatgtaagatagtgcttatatacacatgctaggcactctattattatttgtcaaattaattaatggaaaggcaaaattgtggttaaaaacaaggataaatagcaagcattttaagtagtaagctagatatcctaggagttattggagtttttaaggtaataagtaaacatctaaataaatccactattatcaaacacttcacctgcccagggagtcgtttccactttattacttcctttgactcttctaatccaggttctgtgtctactgagcttgactcatggtgacgttcacaatgcactggtttacctttttcctcctgaagagccatcatagagcggtaagatggctttatctaaatatgcattaaaatatgaaaatttatataccatgttcacctttttctttttctagcatatagtttttaaaatactgaaacaaataatatgaaaatattttcaaaatgtaatccagaaaaaaattctacttttatttgtacattattctaaataaaataaaaaagctgcttaaaactacagtcctgtaaccaaaaagccataaaaattttggaggaaaaaatatgaccacaaaggtcacatgaaatgattttaataactctatcctttgtttctgcttcttcaccaatacttatgagttatgccatggctctgatatactatcatatctctggctttaatatcacaaaactagtatcataaaaatctcaagttttaaaaatcctcatttctcaaataatagatttaactccatccaaaccaatgcaaatcagccctgtggtgacagtacatatcagctacagaacgtgcaaatgacctgaaaaattaatgtcttacaagaaactagacaaaagcaaaacttttttattttagggccaattctttgctaagattatttataatattaatctatggaaaacagcagcagtagaaacattacatactgattatttgaataatattgtgaaaaatgtgcccagaaatcaggagtctgcaaactgcagcccacacaccaaatctggcctactacctgtttttgtaaataaacttttattggaacacatcacacccatttgttcagttatggcctacatatgtctatgtagctattttcacactataaaggcaaaattgactgaaactacagggccaaagcctaaaatatttactatctggccctttacagaaactatttttcaactcctgctttaaatcaaccttttatctttaatttttgaaaatcaaattataacaaaacatttttcctaatactaaaagccacatttcacatttaaaattcatttaagcatcttttaaatatcagctattacaggcttaatatataaccccagaaatctattaaaattattattagaggccttatctttttagaaatgaaaaacatgctatgtcaccatttaatttcaacactagatgatatacacttaatatgtactattaacttacacagtctggaactttcagtcctcttacagttacgtacagtgttgatgggtaatgatttcttggacattttgaccaccattcaaatgcctcaacaacacttaatggggatcgaggcttagtaggtgggtaatatagctgcaagcgaagttttgagttgatgtttgcatttccattggctcccagaagcttaaaataagaattcatataaaatgttaccttcattgaaaataaatatatccaataaagcaatagcataaagtcagaaacatttttaaaagattaatatggcatgctgaaatttcttagttttaaaaagcaaagaacattaaatagttagttaagcacacttccagatcatttttgacaaaaggtagcccaaatggcttttaaaatattttcctgatagctctcttttcacgtgtacaacaatttcagactgtcggtacagcatttacattactgtgccagatttcacgctgaacaaaggaagtgatcaatacacatgtttgaaataattatgataaagactaaactgtatatttacacaagacacaaatcttccatttgtttaatatcagtatttttaatggttaaaattttatgttttaaatttttaaaaagttaaaatcatttcaagataattaaactcattcaagccattcgttacatttttttcagtattttagtatatcttctttcaaaggtctatttttaaaaccctattaaacaaaacttatatttaagctaactaaatggaggtttttgtctctttttttgggcagaatctcgctctgttatccaggccggagtgcagtggcaaaatcttggctcactgcaatttccacctcctctgggttcaagtgattcttgtgcctcagcctcccgagtagctaggattacaggtgcatgccaccacacctggttgatttttgtgtttttagtatagtcagaggttttgccatgttggtcaggctggtcttgaactcctggcctcaggtgatctgcccacctcggcctcccaaagtgttgggattacagttgtgagccaccacgcctggccctaaatggagatttttatgagaaacataaaaatcttaccaactcagaatacgttctctttcattagaccatgactcaaaataggaaatgaaacgtctttctaacctttatgtcttctgcaaattaggagcagaaagatagtttgaaccctttgcaacagttcacacaaaacatgaagtatcttaaattagaagaataagcactgagtgcccggaaggtatttaacaactgttacttgtagactcatgtaacttaatatcttaaattagaagaataggcactgagtgcagggaacacatttaacaactgttacttgtagacttatgtaacttggaaagtaaaaaaaaacaaagaggcaagaaaggctctaagatagtattgtccaagagagctttctataatgatgggaatactctaaccaatttgtgctaaccaatacggaatccacatgtggctaccctgcacttgaagtatggctagcacaaatgtgaaagtaaatttttaattatatttaatttgaattcaaacagccatgtgacttgtagctaccaaaacagtgtaactctaagttcgtaaatctgggagagtggacagatggtggtaccaccaattgaagtggcagagagagtagcacggatactcagtttggaggaatctgacatatctataagtcatccaagctgaaatgtccagcaggtgactgaatttacaaatctgaagcacaggtgagaaaagtggttccaagaaaagtgggttaaagatgaaaccatgagtaagactgatattaaggaggtaggtagaagaccatgaaggaaactcaaagaatggtataagaaaaattaggagaggatggtgtcaagaaaaccaaggtaacagagtttcaagagtgtgatatgttaaatgcatagatgtgacaaaataactaaaaaatgttcaatatatttagcaaacagaaatcactagtgatttggttggagaagctttagtggcagaggcaaaattcagaacgttgttcaggaatgataagttaaggaatgatgcatcaacaaggaaaaagagatggcaaaatatagcccatcttttcccctacccctttaggaaagaatgtaaagacaatggaggttataagctgagcgggtgacattgtgattagtgtcaaatgacacacaggggtaaagaaccattcccaattgagtaatagatatgttcagtcattaaatcataagcactcgagactcccttgataaactctcctacagctccccaaagcttatcacggtaattttaaaaagatattccccagcttctaaatcatactttccatagattaatttaaacaggcaatttagtttacattaatacgttgcttagcctgagtaaacaactaagattcagccaagaccctgccattatggttataaattatataatgtagagctcagataaataaggctttattactttttagtttaaaagaatagccacatatatgtactaaaagaactgaaagtacctgagaatctgaggcatagctgagaattaggataaagtctcatttgaattactgtaataacttaacaattatccaagacatccctcgtaccaacaggataggtaataaaagatttaaattttaattgtcttcatgccacttccctttttttttgagatggagtctcactctgtcacccaggctggagtgcagtggtacaatcacaggtcactacaacttccattccctgtgtccaagcaatcctccccgctcagcctcccgagtagctgggattacaggtgcacaccaccacatctggcaaatttttgtatttttagtagagacagggtttcaccatattggccaggttggtctcaaactcctgacctcaagtgatcggcccacctcacctcccagcgtgctgggattacaggagtcagctactgcatccgtcatgccactttcttgaagatgaattttatccttgccactctttctatcatcaatgattaattccctcaatatatattcaccaaacactttctatgtgacattaatatgctgggagctggtgatattatagcatggagtttcaagagagtgacatattaaatgcaaaaagacctagtaaaataaggactaaaaatgttcaacatatttacccaaaagaagtcattggtgactctaaaaagcttacagtctaatgaagaagacaggtaagtgttagaagacgtgaagcacatagaataccttactctttctggggggtggggatgggataagaattcttgactgccatttttgccaatggcataagatgaataaataaataaaaatccatatagtacttagaggtagaaatgccctgaaatatgttactgcttcctaagtgcaacttacagtaaattctgcaggtctgcacaaatcttagcataaaagaaatgcagtttctaataaaaccacacgatggcactgtttactatgtgaaagtgagttttttgctttttttttttaatggctttttttctttgctctaaatcagtatggaaggtgttatggaaaaaggcattaacagatttataaaagggtgatcatcgatagcacactggaccaggtgattgctaaggccactctcaaattacttactcaccatagccaacctggtggctgttcagccctttgactataaaacttctaaaatctctctctaacctccaatatggattaaatgtctcaactggattttaacagcatctgttctatagcacataataatgtaggtaacaggtctgtatagaaattaaattggagggcagctatatacaatgtctaatttatctatgaatgtactgaatttagcagactgtctcacattttatagatcatatttgttgaatgaatggattcacaaatgaaaatgtttttataagatggtacaaaataattactcaagacttttcataatttaaattgatgtttgaaggaaaagataattacaaaattaaaatatccttttttaaacatcaatctacgcctttcatctttgctgaaacatctcgtcaaagacatcctagtcagagacacctagtcaaagacaaatgtacaaagacattttttacctagactactgttaagaatttcctaatgtgattttcaagtatctacatttgctccctctagaatctgttctccacataacagagtatatatctttctaaaacacaaatcagattattttattcttttgtttaaaatcccacagtggcttcccattgctctttaaattctataatggcttcctcttgctataatgactgagaagacctcatcataattaacatcccgttgaccttagcaacctcttcatgcaccattcttctccccttagtctctgtcctccaatcttggtggccttcttttgattttctgaattaaccctgctccttcaaatatcagggtttttgcatatattgtaccctctaccatagaccatttcttccccaccggtggcaatgtgtctcttcctcaggaatgttttccctgaccccacagttcatcatccatcctatacctctttacgatatttataaaaatttataattaaatgataaattgtgaaatcaattgttttatgtttgtgttgctggaatatgaagtccaggagttcaaggaatttgtcatctttgtccactgacaacagtagctggcacatagaaaagtcttaatattttttgaactgaataaataatggcatggctgtttgtgtcttttttaatgctacatcctcagaaccaaatagtgtaactggcacatactgggccatcaataaatatttaagaatctgaatgagcataacctgagcttgaattagtaactcttcatccctacaacattaccttagattctaattccttatatgagaccaaactgatttgggagaaagcagccaactaaatttgaagactagttttaaagtgtttaaaatggatgaaaaacataccttaagaaatgcccaggcaattttccgaaagccacattcttggttttgaacctcagaattattcttaatttcatccacgcttaagaaatcaagaatctgcaaataaattcacagaagactaagctacctaaaatttaatattttctaatggtacattattaaaactttaaaaaatcatttgtatagtgcttaaaaacattaacctttacagggaataaaaacatttttatctcatttcattcaccttaaagttaactcattcagttagggagggtccattttctgactattttatctttcattaataaatactatgatttatttcaaatccaaagcaaagtgttaatcacctcaaatataacctaggtacaaatataataggcatagaattcttaagctttcattgttttttatgtatcacagcagactttaaaggattgtttgtttaaaaaactcacaaccctatttctgggtctttgtcttggatcaccttcctgaagttggggtttttctctttggatgtatgttataattaggcttctcaagaggatttcttccattcctctatcctgtctggacattaaagctcatggatttgcaaccaacctgccacagagatcgtattctagatatttatcaaaggctatcacttcaaacttactggtgcttattaaaagctcagctgcgaaaatgagatttttatagaaagaagactgcttaagaaatgatacagactccaatcatctgtgctttttggatacctaaatcttttttacagatataatacatgctcagtgaaaacataatataaaaaatatatagatccaaagtaaaaacaacttgtaatccagacccatagatggtcaccattaacatctagtttgcaggccaaatctttttctgtgcattcctaaacatatgtgtggaactacaaatctaataatgctatttcacaaattattttcatatagtatgtagtgaatatctcttcatgtcaatacatacacatgaataccgtaatgttaatgactgcctactattctgtcacaaataccataaatttaacaaaaattataacttatttaaccaaatctcttactgatctaaatgtaggttattttatctccctaaaatttttgctattataaacagtgctgaaataaatatccttgcacacacatcttcacggacttgtcatttttttccttaagataaatacctaagagtaaaataatggttttaaagactgtgagacattatcaagttgtcctcaacacttaaaaaactgagatcaaaaagcagttgcataggcaataacatattacattaaaacttaagaagcaaccaaaagcgtttataatacaacaatctatccttcttcatctcttaatactaaaatgaatacagaagaaaattgtaacaaatgacaaagtttgaagacaaaaaattccttaagatacaaattatatcaatttttcaacaataacagctttatgtaaatcacacacaacataatcacaaatgtaaatattggaatatttgtatcataaatacaaatagacaacctgaaagtcaaggatcataaaaacaagtaattctacaaaatgaatcttcggcactggttatgccaagtcccctgctgttcccatgctaaacttctccatctagcttacactggaagggggctttctctattgtcctttgcttatggagacagaacacatgatagagtaaagaaatgtggtattctaggttcaaactatctgcaaacgcattttttttaacttaaaattcgagtaactttggggaaatcacttttattccaaaccttgttatcattttcagtaagaaaattatataataacaactagtcagctcaaaagccatgtattccataaagctttccctgactccactgacccgccactaacccttcacatataagttctacatcatttttggttacatattaaactgcattaactgatctgtgtacatttatctttatttatccaggtggtacacatattcttagggtgcctgacatggttaaatgagtttatgctttgtgaaatgggtttaaaatggagaaatgcattcatatcgagtggattcatcacttcactacagttaacagtcacagagctgttgtaattattaaattatacaaagtaggccaaatggttaaatagtaaacactcagcaaatatgctatcactgtttataaaagggcgtctcacttgattccacagcattggaaaactaaatcctagagattaaattctcacacaacttttttttttgccttactggactactaaaaataatagcttacatttgtgctattaaatattaactatcgtttaatttgaattggtccattcaattcatacctcaaagaacaggatgactttaggactctcatcagagcctcgaagcaaatagggaaaattttcattaaatacaatttgttcttcccactctggaagtcttgattttaactgtttaaaatcatatggctgggtcataataggaagaatataatccacattctctttttcatagtaagatgaaacaggccgtccactgtacaaaaaaagatacttccattaacacaattttcataattttgaggtgagaaaaaaatatatagtgtacaaggtgaggcaaccagaaataatgaatagtcataataatacaaaaggaaaaattattctgagtgtccatctagaaacttacaaattttataagacttaaaagtaacagtccatcttatatttgtctactatcaattggtttcacatgattattttattatagaaatataaagtgagaagtatgattatacctttgccatataaagctgggataaactaactccttcagaattttgtaagagtttataataaaatagacattgccaggcacagcggctcaagcctgtaaccccagcactttgggaggctgaggcaggtggactgcttgagctcaggagtttgggaccagcctgggtaacatgatgaaacctcgtttctacaaaaaatagaaaaaaagttagctgggcatggtggcacatgtctgcagtcccagctacgtgggagtctgaggtgggaggatcacctgagcccagggaggttgaggctgtagtaagctgtgattgcaccactgcactccagccagtgagacgcagtgagatattgtctcaaaaaaaaaaaaaaaagacataaaattgattttacataaaaaaggcacaagactgtaaaccctttgagttgtcatattttctttgtgtgccctaaggcaaatgaataggtgaatgggctttttttggacaatcttcctgtttccattccccactggctttccaaacaattttttaaaaaattctagtataaatgtgtatttcattgtacttttcatttgggatttcaagcatgcattagctatagaagtactcttagaaaaaacattcaagattcatttaccttacctgaagcccagataacattactttcaaaagaaaaatatgaggttagacaattaaagcatttacaatgcaatataaaatatttacaatgcaactttatgtcataaattacatctactaagctggcagaagctctctaccacttaaaatgaattattcccttccacttaaaagtaattactgagccaggcacggtgggtcatgcctgtaatcccagcactttgggagggtgaggcaggtagatcgcctgaggtcaggagttcgagatcatcctggccaaaccccgcctccactaaaaatacaaaaattagccaggagtggtggcgagtgcctgtaatcccagctacttgggaggctgaggcagtagaatcgcttgaacccaggaggcagaggttgcagtgagccaagattgagcactgcattccagcctgggcgacaaagcgagactccatctcggaaaaaaagtaattactgaattagatgttctccatttcttctacaacattctgatcaatgttaatgactgatgaacacctacaactagtagactattctctaatacaaatccataactctattcccactgactttcaactaccaatggcagaaaaaagacttctactagtttcagtttcaagaattagttgtgcaattaaaaaaaattacctatcatctttcttgacatattgaccagtatgctcatcaaccacatgaatttttaccattgggtgagaaatcataaaatctgacttaagtctatcagttcggtgaatgtaaactcccaagacaaggtcatcatcaagcaaacatttgggataaaccgggctatctcggcttgttatttcatgaacaccatcaccatcaacatcttcattattatctgcaactacacgcatggaaaaaaaaatcaatgttataattagttgttcccatagtagtatttacatataacctaatctttaagatctgtgatgatctcactgtgttcaaaggaacttcagggggaaagaaagaaaaagccagacaacagcaaaccatagtgtgaaagtaaaatactacatttgctaatacattacaaataaggtgaaaaatccttgtttatatttttcctaataagtaggagaaacacaaaaagaaaaaaaagagagtcaaagtcagaaaagtaactttatccaggtattttctaagtagaatatatatgacaactagaatttctaattctgggtgggatgcagtaggatgcagcaggtaaacactttgggtaacaactggaaagagccaaataaattacaaatatcttattttaaattttaaaggcatcagaaaagtacagaaagaagatatagtagacagattaaaattccagaaagggagaatcagtcagaggtcagctgatggactggcagctgtttttgtctctggggacatttgctgattcagggtgtgagctgaagatgagagtttggcttaggcagaaagtcactgccaggagaatgagaaataagcaaaacttttagtgattccacaggactaaaatgataaaactggagatttgagaagcctcaaacacatgaccaattcttctcacaaaactgaattctgatgctacagagaagctagagaggtagtgaaatctcccaggcttgtggtgctagcagaccatgatctgccaggggaaggggaccaaaacaaaataggcaaaggtgaagccctggagggtgtggtcaatttacactaaggaccaagagcaacttttcatctggggtcatctaccaattctggtcacagttctaggttgataatccaggtgtgatttctggcagaaggttgctactgagggacagagaaaccagcggatattttggcatgcttgggggctacagtgacaaaaatggatacctgaaggatgtctaacatatagccagtctcctgctcaaagaatttgccaaattttgaagcagcatgagacagaagactaaatggctaagtggaaaagcactgaagggcaaaactggatctcccatcgtatttagggctatgaattattagagataaagaagggcgctgcattatgataaaagtgataacttgacaagagatacaagaaaaataaactgaaaatcggaatggaaatgttaatacctctctcaacagctgacagaataagtagaccaaaaaaattaataagaagaactgagcacaattaaacttgacctaactgacatacataggacactgcactcaacattagaaattgcattcttttcaaatgagcatggaatatttaccaaatctgaccataaaatggtcattaaaaaggcctcaataaactcagaggattgaaatcattcataatatgttatctgacaacaatggaagacagaaaccaataaaagataactagaaaagcatctgctgcctgaaactaagcaacatacttctaaataatgatcaattaaaatggaaattagaaaatattttgtgttaaataataaaaacacacaatattaaaaattttggagatgcaggtaaagtagtacttaaatgggaatttagtcttaaatgcatataaaagaagactgaaatctttcttataaaacccaattttaaagctagaaataagtagcaaatcaaacccaaataagtacaaagaaggaaaatacagttacaagaaaaaaaatcactaaaatagtacataaatgtacaacagagaaaatcaaagctaaaggttggtttttgaaaagactcataaatttaaaatcctaaggctgatcaagaaattgagagaaaacaaactgccaataccatgaatgaaaacatgggacagcctttcagatgctatagaaatgcaaaatttggatgaaatagacacatccctcaaaaactacagtatatcaaatagctgacagaagtaaaaaaaaaaaaaaaaaagattgataataaagagattaaatcttgatttgtatcaaggcaagcaaaatgataaggcataaggactgaaaaagaagcgataaaactatcgttattaacgtattacatgattgcatatgtagaaaaatccaaacaatgtaagaataaactctgtgggccgcgatagctcacatctgtaatcccagcactctgggagactgaggtgggagaactgcttgagcccaggagtttgagactagcctggaaaatgtagtgagaccttgtctctacaaaaattagccaagaatggtggtgcatgcctgtagtcccagctacttggaagactgaggtgggaagatcgcttgaacctgggaagtataagttgcagtgagctgagatcacgccactgcactccagcctgagtgacagggcaagaccctgtctcaaaaataaataaataaataaactcttgcaataagtgaatttagcaaatcaatggacacaatgttaaaaaattttaaatacatttctacatatatgtaccagcaacaaatacaaaacaaaaattttttaaatgccatttataatatcattaagaaacatcaaatcccaggaataaatctaaggagagattctgctgaaatgtatattgctgggatatattaaataagatgcaaataaatggaagtgcataccaaattcatagcctgagaatcaatactgtgtaaaaatgtcaagtctctttagagagttgttatgctgtgactctttagattcacccagtctagatcaaaatcacagcttgcaagacagaatgagggtaaaaaggaagagggagaatggagaagctcttctaaaatccatacagaaatgcaaagtaaagaatagcctagacaatgcagatgaagaaggaaaaacctagagtataatactaaatagcaagacctattaaaaagctacagtatttagacatggtagtgttggtacaaactgtctaatttaaaagaatagagactacaaaaactgatccacatgtaacacagtcatgttatttatgggaaaagtgacactgcaacacagagggaaaaagacactctcttcagtaaatggtactgggtcaatcataatatatattcacatggatatcttgatcactgcttcctatcataaacataaaccaattcctgatgaactgcatatctaaatgtgaaagtaaaacagaaacagtaaaacttttagaataaaacttttagaaaaatatcttcagaacttaggaaagatttcttaaatcacagcacttaccatcaaaggaaaaaaatggataaactggacaatacaaaaatttctgtttttcaaaagacaccaatgagagagaaataatcaaaccagagtaggacgacatttgcgatataaatgtgggtaggtatttatatctgagaataatctcatattgaggtatataaacctatcactacaaatcaattagaaaaagacaattctgtgttttaaaaaatgcagacaacttgaatatatttacaaatgtcaaaatctaagtagttaataaacatgaaaacactcaacttcaatagttaccatggaaataaaattaaaaccaaaatgaatatcactatacattcctgaagaatgaggaaaatttagtcactcctaagaatgactaaaacgttaaaaaacagtattacatgttggtaaagatgtggagtgactggaactctcaaacactgctagtgtcaactggtaaaccaactttggaaaactggaagtaattattaaagcaaaaaatatacataatctatgacagcaattctactcctaacaatatgcccaagataaaggtatgcatgtgcttaccaaatacgtgactgcaatgtgaattaccgctttacttataattgcctaaaactagaaacaactcaaatgaccatcaataaaataggcaaattaactgtggtatattcacacaatggatatctaaataatacaaaaacagaattaagaatgaataagctcaactgtatgcaagcaacagtagtataaatcttacaaaattaacattgagtaaaaaaagtcaggcacaaggagcacagtatttatcattctattcatattaaagtataaaaataagcaaaaataaactctgttagatgtccaggtagtggttactcccacagggcaactaacgggaaggtgatttttctgggtgctaatgatgttctgtttccaaatttaggtaatgattttataggtatgttcagtttgtgaaaaaaactttaaaaatatgtatatgagtatactgcttagtgctttatatatatagaaacacataaaacaagtatactgcttagtgcttttctatatatatctatatacacattatgcttcaacaaaagattttaaaattttaattatagaaaccacaaaacatcatcacttacatcttctaatgaataagtactataaaatctaaaattgcccattttaatcccaatttttggccaatcaaatggaaactgaaagactaaaaaaggatgtatgagtagaaaagaacatgtaaagaaaaataagagaaaacaaacaagaaaagaagaagacagaaatcaacaaggcaaagagaaaagttgagaaaggaaagaagtggtattaggctgacgaattgggaggataccatgttggacaggatgcagccttaacatcagaaatgtttattggctgctgaccatttatagctttcaacaactgagtcctaaccatttagaggatgtaaactcaatggtttaaagaagaaatcctctatgacccaatagcaactacaaagtcagtatcattttagagttgaatttaaagtatgacaagaatcagagaaggtcaggcatggtggctcatgcctgtaaccccagcattttgggaggctgaggcaggtggatcacttgaggtcatgagttcgagaccagcttggccaacatggtgaaaccccgtctctactaacaatacaaaaattagccgggtatggtggcatgcatctgcaatcccagctactcaggaggccgaggcaggagaatcgctttaacccgggaggtggaggttgcaatgagccgagatcgtgccactgcattccagcctgggagacagagtaagacaccatctcaaaaataaaaaaaatcagagaagactcaagtgatacaaactcatcagagacctacagctacaaatacatgtgtgctttaatctagatgaattcaagaacaagtaccaaatatcctatattgaattattttcaagtatacccatcagttttaaagggctaaaattcctagaatcaagttatttctaccaacatacacaatttttcatttaatttgtatagcaaacctgctttagtcttcttttttgttttttttggtttaggttttgtatcatcttgcatgctgtcttctgtgctttgttccattgagcttatttcatcatcttgatgagaatctgaagaaactgatctaactgaagattctttcttttgttcaccttcaactgtgtcaccagagatggtcaatgtactacaaatataatccaagtatcagccattacagatatattatcattataattattattcatgatgcaacagagtgaacagtaaataggagcaaagataatcctaaaatcactattattgtctcttgagagatgcatgtattttcttatacactaaaatggttaagtgtcaaataggtatcataggtggtattttatacttcgtgaggagttacacgattcaactaaaactgagctctaaaccccaggggaaagggaaattgtattaatattttatgagcaattgatctctctttacataggacttatcaaagcatgcccaccctgctgccaagtaaatgatttatcaaccaatttttaaattaccttatttaaaggtataaaaagtattctaggtttgttccgtcttcaagaggcttcacatgcacaacttttgatttctcttttttcttttcttttttttttaagactgggtttcgcgctgtcgcccaagttggagtgcagtggtacaatcatagctcactgctgcctcaacctcccaggctccagcaatcctcccacttctgcctcccaaatagctgagactacaggcaccatacctggctaatttttgtaatttttgtagagatggactttcactatgttgctcaggcatggatttctaggtaaaaattaattccttggtgagtcactacattttcagaaggctattactaaaattaaaatctatatcacatgaactagtaaatggtaagaagtagcaacccagaagcatactgagtttaaagaaaaaccagcctactaacattttaatgtatctagtaaaaaatctgcatgtaaataataaaaaattaatttccaatatttttagtcatatttcaaaaaaaaaatgggttgaggaaagtaagactagagaaatatttcaaattagtcattccagaaagccattctatttgatcacatcaccaaaccctgttctttaaggagaacagctaccctttgcgtgccactgtcacgtgttattaaaaattcatgagctaaccctatttcatattgactatggcttaccagtctaccacagaggtggtagctatgagaaggaagatttatagtatactatggtaggaagcctctaagatggaccttactgatccccacctcttcatattcatgtctttgtgtaatcccctttcttttgtgtgtgggctggactagtgacttacttctgacagacagaatatgataaaagtaatgaatgccacttataagattaggttccaaaaagactgtgacttctgtcttgctctcactctctcagagcccttggtctggggaagcaagtggccatgttgtgtgtagaccatatggagacagtccatgtggcaaggaactggtataccgggcccaaagccagtcaggacctgaggcctaccaacaaccacatgaatgagcttagaactggatcttctaaggccttctaacagctatgtcacttgacagatcctcccccagtcaaggcttgaggtgacttcagtcccagctaacatcctgattgcaacctgtgattgacagagacacccagtgaagtcactctcagattgctggcccacagaaactctgagacagtaaatgcttgttgtcttaagctgctaaattctgggatcatctttttaatggagcaacagataactaatatatactatcatgtccctgcagcaacttggtttgccgtatctttattaccaccggtcacctagcttttgaaaagaggggaattatttttggctgagggctttaggggaaattgatgctgaatgccaaagaatagtcacatataaaatgttcccacctcaagttgtttctctagaggagaactgcaggggggaacaaagttaattatagcagttaaaaagcatttttaccttattgttttctccaaatagaaaacatataaatatgtgtatgttcacttaacctcacactctatatagaagtacatacatatataagcatcatatagagaaaaagattagaataccaaattgccaatagtgattatctttgaatagtttttctacaatgagctaatgttatctgtataagaaaaaaagttatatttatatatccaaacaggtatttgtaactcaaaaaaggggaagtaattaggtttctattactttgaaagcagatgtaagtgagtagttcagggtagggacaaggatctggctcagcctcttactagttctgtacttccatttcctcatcagcaagataggaagaatattacttttccttataagattgtcataagaaataaatgagttaattctcgtaaagcacctagtacatagtaaggtgttatgtaaaagttagctgttcttatcttagtgacaatgtctccaaataaaagcgtaagaattttctttgttaaaccacagataatattcaaaacctgaaaataacagtgtttttctaagaggatattttacatttatcaatgcaaaaataccttgtttcagctttagagaagactggaacttcctttttctttttccttttttcactgcttagtttgtcatcatggaataaagtatctgagggaaagtaagtcaactgttctttcagtttctttcttattttcctcttaatctcctttgccatttcttcagttacatggcactgatatgcttgcatcaattcttcatcctcttctaaatcagtctcttctcttccctcatttgccttctcacttttctgatgatcaacgcctggctgtggctttgtatgtgttttctggtgtgtagaatcaaccttattctcaggagtttccggtttcaggtcttgtgtagtcaactggggcaccgtctttatcacctttttatttggctttccttgtttgtcttcctctacactagcatcaccattaggattttcagttgctaactgtgtgttcctcaatttgtttttagtgactctcgtgctcttcttcaggttgttagtgttagcagcacttacatcatcacttgtagtttctttaatatggggaagattgcttctaatagtgtcgggctaggaaaagaagacatgataacaaagtttcagttacacatagattagttatataaagaaaaacctaataattaatatttgacaatgtggaattattgggaggattatttagtttttcatctggacatagtgacactattttagagcatatgagtactctcataatttatgcttccagaatttgattagtaatctctgaatgtaacttcagattaaatgagttaattgacatgggaaaaaagtacttaaggacctataagaagtgaattaattgctcaaatctcaaatgctattttcctcatacatattttcctcatgatctacactctaatagatattcgagaaattgctaaaagagccattgaatgtgacatttcaggtcacccaataggaaatatacatgggtcatttattttgcttcataattacactctaaaagcaaaagtctacagctctaagatcaccctgcagtaaatctaagtgtatcactaaaatgctgctaaatattacatattaagttaaatccaatgacagactaagcacaatcttgtacctccttccccaattaaaattatttaaaatgagatatatttttaatagaaaaaaataaataaggataagagtcaagtaatacaaggaagaggaggaggggataaactagaggatgaccaatcgaggagctgggatgaacagctctgtttcccacctccatttgtgttgactttcacccatgggattaagcatcccagcaaagagagaaagggcagtatgcttcaggtaggtataattcccataaactgcagaggcagaccatgttaaaaacaactaacaaggaagagaagagagattctcaaatgtaaagatggcttgacaactgaaaattaacaaacactaaaggaaggtagcacaatgaaggaaagccaccaaatcaaatacaataaataaatgaacaccaaaggaaaatacatatcatatgtaagtatttaaaacaagtatagttaatattaataaagaaatgcaaaagcatactggagcaagaaaacccaactgctgatattaaaataaaattctgaatgataaaaataaaagtttaactgatgtgttgaaaaacagaatggacaaaaaccattgctgactgtgtattcctcaatttgtttttagtgactctcatgctcttcttcaggctgttagtgttagcagtacttacatcatcacttgtagtttctttcatatagtgaagattgcttctaatagtgtcaggctaaaaaggaagacataataaagtttcagctaagcgtagattagttgtatcaagaaaaaccaataattaatgttcaactatgtggaattattgggaaaattatttagtttttttacctggacatagtgatactatcttagagcatttgatgagtactctcataatttatgcttccagaatttcattaataatctctgaatgtaacttcagattaacattttggattaacactttggattcattttgtcatgcacaatgtcacattgtaatgtatgcaccttacatgttaacattcggtgctacaagatgaatctaaaatcaaaataaagaaatgtgccagaaatgaataaacttaacaatacatactggggtttgatctttgaaactccccatattttaaaagtagttaaaaaatatccaatgtatataaaaaggtgatttaaaaaatgctgaaagaactagtatcccaatacatatctaagattttaccaactctaagactcttttgctcacctaaaatatatttccaaattctatctgttctttgagggtaaattatggtgccacagcctccaaaaaaattcactaatcaaatctaattatattcacatgttctgttttagaagcaatatttaatttaaaacagtaaaaataaataaataaggaaaaaaacccccagaaaatacacacacacaaaacccaaagctagcagaagacaagaaataaccaagatcagagcagaaataaaggatacagagacacaaaaaacccttcaaaaaatcaatgaggctgggcatggtggctcatgcctgtaatcccaacagtttgggaggccgaggtgggtggatcacatgaggtcaggagttcgagatcagcctggccaacatggtgaaaccctatctctatcaaaaatacaaaaattagccaggcgtgacggtgcacacctgtaatctcagctacgtgggaggctgaggcacaagaatcacttaagagaagaatcaaatagacacaataaaaaatgataaaggggatatccccatcgaccccacagaaatgcagacaaccatcagagaatactataaacaactctatgcaaataaactagaaaatctagaaaagatggataaattgctggacacatacaccctcccaagactgaagcaggaagaagttgaatccctgaagagactaataacaagttctgaaattgaggcagtaataaacagcctagaaacaaacaagcaaaaaaagcccaggaccagatggatttacagctgaattctaccagaggtacacaacagaactggaaccatttctactaaaactattccaaataattgaaaaggagggactatttcctaactcattttatgaggccagcatcatccggataccaaaacctggcagagatgcaacaaagaaagaaaaaacagttaaggccaatatccctgacgaacactgatgcaaatatcctcaataaaatacttgcaaccaaatccagcagcacatcaaaaagcttatccaccaccatcaagtcagcttcatccacgggatgcaaggctggttcaacatacgcaaatcaataaacataattcatcacatgaacagaactaaagacaaaaaccatatgattatctgaatagacacaggaaaggcctttgataaaattcaacattgcttcatgttaaaaactctcaataaacaaggtacttatggaacatacctcaaaataagagccatttatgacaaatccacagtcatactgcccaaagtaatttataaattctatgctattcttattaaactaccattgacattcttcacagaattagaaaaaactactttaaaattcatatggaacaaaaaaagagcctgtatagccaagacaatcctaaacaaaaagaacaaagctggaggcatcacactacctgacttcgaactatactggagtaaccaaaacagcatggtacaggaacaaaaacagacatacagaccaatggaacagaaataagatctcagaaataagactacacatcaaccatcctgtatttgacaaacctgacaaaaacaaccaatagggaaaggattccctatttaataaatggtgctgggaaaactgtctagccatatgcagaaaattgaaactggaccccttccttataccttatacaaaaattaactcaagataacttaaacacttaaatgtaaaacccaaaactatgaaaaccctagaagaaaatctaggcaataccattcaggacacaggcacaggcaaagatttcataacaaaaatgtcaacagcaactgcaataaaaacaaaaattgacaaacaggatctaattaaactacagagcttctgcacagcaaaagaaactatcatcagaatgaacagacaacctacagaatgggagaaaatttttgtaatctatccatttgacaaaggtctaatatccagaatctataaggaacttaaacaaatttgtgagaaaaaaactaaacgaccccacaaaaaagtgggcaaaggatatgaacacacacttcttaaaagaagacatttatggggccaacaaacatgataaaaaggtcaacatcactgatggttagagaatgcaaatcaaaaccacaatgagataccatctcacaccagtcagaatggcaattattaaaaagtcaagaaacaacagatgctggtgaagctatggagaaataggaaagcttttacactgttgatgggaatgtaaattagttcaaccattgtggaagacactgtggcgattccacaaagacctagaaccagaattgctatttgaccaagcaatcccattactgggtatatacccaaaggaatatatgtcattctattataaagatacatgcatgcgtatgttcactgcagcactactcacaatagcaaagacatggaatcaacccaaatgcccatcaatgatagactggataaagaaaatgtggttcatatataccaatgaatactaggcagccataaaaaggaacgagatcatgtcctttgcagggacatggataaaacgcaggaacagaaaaccaaacactgcatgttatcacttgtacgtgggagctgaacaccgagaacacatggacacagggagaggaacaacaaacactggggcctgtcagggagtttgggggagggagagcatcaggataaatagctaatgcatgtgtggcttaatacctaggtgatgggtggagaggtttgttacctatgtaacaaacttgcaagtcctacacatgtatcctggaacataaaataacatttgaaaaaattgctatttgtttcagaatcttctttttgttttttatgacttttattcatacctcaataaccttgaatttccattatgttaaaatggggcatatgcaaatttttgtttctactttttcagtgagtaccaataatgtagcaccaatatatacaaattgtgaggatactcctgaaagaaataattagaaaaaagagctaatcaagaattagaaagagaagaaagatttatggtctcaaggaaaaaattttaaaattgaaactccaggcaaactaatcagaaaaggctgttttttgtttatttaccactgatctgtcagcctttgcactaataacattaattttatgactttattattaatttgtctttttctttagttctgttttttaaatacagcaatgaatgaagtttccagagtatcttcagtagcatctctacctttcatagcattacactgacattttcattactttttaaatagcctgattttgtggttttgatttcctttttccctctaacagctttatgggataaattcccaagtagtttgtaaattataaacttttgttaacttctagttgtactgtactattttttttaaaaaagtctcctttgtggaattcagcagtttcatggatcaaattatgtttgaattttgaaacgtcccaaatacatttgttcattcatgttcctattatacctttgccaattttttacctctttaaatgattcaggtttttttttgctttggtttatctgctattaaaatcagctttattaagatatagcttacatcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaaaaaaaaaaagatatagcttacatcaataaaatttgccaattttaattgtataattaaatgaattttggcaaatgtatgcagtcatgtgaccaccaccataatcatgacattgaacatttccatcattctacatgtcctgttacacagtcaatgccttccctccatgctctgaccctactcaaccactgatctggtatcacaatagctttgccttgtctagactttcacataaatgaaattataccatctatagccttttgtgtctggtttccttcattcagcacaaagcttttaggattcatccatgttgctttattcatagcagtttattccttttttgtggagtagtattccattgtacagttatatgccacattttgtttctccatacaccaattaatagatgtgaattatttccagttttgtgctagtattagatatgttttcatttctgttgggtaaatacccagaagtggaattgctgtgctacatggtaaacagatatttaacttattaaacaattgccaaacagcttctcaaactggctgtactatttcgcatttttatcagcaatttctaagagagttccagttacttaccatccttgtttgcacttaatactgtcaatttttgttttgtagctgttgtattaggtgtgcaatagtacctcagtattgttttaaactgcattttcctaattactatgacagcaagactctttacatgtgtctatttgctatctatagctgtcctttcgttaagtgtccaaatcttttgccctttttaattaggctgtttgttttcatatcagtgagctgtaagagctcttaaaatattctagatacaacattgtatcagatagtgctttaaaaatattttatctaaacctatagctataaaatattttcatttttgtagcaatgctttcaattttcacaaagtccaatttagcccttttttcttttatggttcatgtttttgtatcctgagaaatctttgctcaacccaaggttacaattatcctatgtttctcttataagttctacagttttagctcttaaatatgtctttgatccacttctagttaatttttaaacatgacatgatcccaagtttattatatatgaatatctgattgttccaggaccatttgttgaaaagattatccttgcctttagtgaattaccttggcaactttgttaagagtcaattgaacatatatatttgaatctatttctataccctattctgctctactgatttatatgcctatctttatgacaattccagattgtattcatcactattgctttataatgagttttgaatcagaaagtgtaattccaactttgttccttttcaaaattgttttggctgttctaggtctgttgtttacagttcccaataaatttctggttttttgactacttctattaatttctgagagaggatactgacatatctaactgtaattgctgatttgtctatttctcatctagattttaaagaaaaagaagtctcctggcattgattaggattgaatttaacagatcatttgtcagagaacggacatttgacaatgttgattcttctgatccatgaacatgaatatctatttacttaggtctttatattcagcactttgaggggttcagtgtacagctcttgcacatttttgataaatttatccctgaatgctacacattttttctattataattttaaaatttaatttcaagtgattcattactggtatagaaatacaattggtttttacacattgaccatatattctgctaagctccctaatacagacggtccctgaatcacaatggttctatttatgatggttcaacgtatgattttttttactttatgatggtgcataaacacgcattcagtagaaaccatacttccaagtatctatacaattattctgttattcactttcagtacagtatctaataaattatgtgagatattcaacactttattacaaaatgggcttggtattaattttgcacaactgtaggctaatgtaaatgttctgagcacacttaaggtaggctaggacaagctctgatgcttggttgcttaggcgtattaaatatattttcaacttacaatactttccgtttaaaaaggacataatcccatcataagaaccacctgtaacttctagtagcactttttttgtagatttttttgggatattaacatagacgattatgtcatttgtgaatacacagtttacttcttcctttacaatctgtatgcctgtaaaaattgcattaccgcattcgtcagggtctccagtacaattgtgaatacacacagtgactgacacatgctcagcttagagcaaaagcattcagttttgtgccattaagcatgatgctagctgcatattttttagatgccctttattaggttgaggaagttactgtctattctttttttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttgccatctatatttaaaaggattttggtatgtatttttcttgcaatctttgtctggctttggcagctgtgtaattattgcccacaaaaaggagtggacaaggatcacctcttattttacagtctggaagagtctgtatagaattggcattattctttcatcaaatgtttgagaaaagttactaatgaagccacctgggagtagtttcctttgacaaaagatttttaactacagattccgtttttttaaaagatatataatgttcgagttatctatttctttttgagtgagcttcagtagtttgtgcccttcatgtaatttacacatttcatctaaactgctaaatttattgtcataaagttactcataatactcttattatccttttaaggtctgtagcatctaaagtgaataccctcttacaatcctgatatcggcaatttgcgtcttctttccttgtttcccaatcagcctggatacaggtagtacagaaaacagttaattcatgagcctgggttgctaaaaagctgcaaatcccaagaagggcatatttttaggaccagtccttgaaatgttgtgcttgataagagtgtttctaaatgcctgaagccttgggccacactgtaacagttttgccagaaagcttatgttagcaatgtgatttatggtgaacatgtgtttttgctttgggggtttggagtctgagcagctgaggtcggtgacacaggcactgaatgctctgcctctacacaaagcccacatagccctctacacaaaaccatgaacatcaaggcttgggttgagcttccctgggtggcaacactttgcacattttgtcacatgttgttggaggaattaagtgagtcccttgcaactctactggggggtgtacctgaaagcttgcacctggtttctcctgggctgtgtcccatgcaccttttccctttgctgattttaatctgtatccttttacagtaataaatggtgtgggtataacagcttttgagtcctgtgagtctctctagtgaattatcaagcccgggggtggccatggaaacccccaacacatatgataaccaattttattactcttttaaaaaattacatttggatttactgaaggttttctattttactgatttatactcttcttatttctatcctgtgtttattttgtctaatttgttcttcacacttttttaaggtgaaagcttcaatgatggatctcagaccattcctcatttttaatgtaatgctacaagtttccttctaagtaatgcttcagcagcattccataaattttgatatgctgtaatttcatttttagttagttcaaaatatgttctaattcttttgtgttttcttcttcaatacattgatctggggtcttattgaacttccaaatatttggtgatactgcagataacttttggttaactatttctaatttgatgctgttgtggcctaagaaaacattttgtattattttaaaattttcttttacatttaaaatttttatttaatttttatatataaaataaagctatgtagacttgttttatgggccagaatgatgtctgtctcggtgaatattccatatgcactagaaaacaatgagtattctgtgtttgttgggtacaatgttcccataaaactcaactcaaatttgtcagttactgaaatctacattcttattgattttttgactacttgttgtatcaatttctgaaagaggatactaacatatctaactgtaattgctgatttatctatttctcatttcatttctataggtttttgctttgcatattttgaagctttgttatgagtttcatacacagtcagttatatccttgatactgacacctttatcattaaaaagattccttttcatctttggcaatattctttattgtaaaatatactttctctgctatcaatataacaactccagttttctttttactagtgttagcatggtatatgtttccattctttaaatattaacctacctatgcccttacattgaaagcaagtttcttatagtcaacatatagttgggtcttatttgccaatctgacactttctactttttatttggaccatccacatttaaattattcttgatattgctgagtttaaatacactattctattatttcctttctgtttgtcctatttgttttttgtctctttgtcctctttttttttttctttttttttgagacagagtctcgctctgtcacctaggctggagtgcagtggtgtgatctcggctcactgcaagctccacctcccgggttcatgccattctcctgccccagcctctggagtagctgggactacaggcgcccaacaccacgcccggctaattttttgtatttttagtagagacggggtttcactgtgttagccaggatggtctctatctcctgacctcgtgatccactcgcctcggcctcccaaaatgctgggattacaggcgtgagccaccatgcccggccctctctgccctcttttccaactatctttctcaatagatttttgtgattccattatcattattggctttttagctatccttttaaaacaaatttatgaagactctaggttttataatacacatatttagcttctcattgttgatatggtttggctctgtgtctccacccaaatctcatgttgaattgtaatttccatgtgttgaaggaggggcctggtgggaggtgactgaatcatggggacggatatccccttgctgttctcgtgatggagttcttgcaagatctgattgcttgaaagtgtgtagcacgtcctccttcgcactctctctctctctctctcctgctctggccatgtgaagtccatgcccgcttccccttcaccttccaccacgaatataaatttcctgaggtctccccagctatgcctcctgtatagcctgttgaattgtgagtaattaaacctcttttctcataaattacccagtctccgctctgttgcccaggctggaatgcagtggtgtgatcctggctcactgcagcctctgcctcccaggttcaagttgttctcctgcctcagcctcctgagtagctgggactacaggcatttgccaccacacccggctaattttttttttatttttagtacagagagggtttcaccatgttggccaggctagtctcaaacacctgacctcaggtgatctgcccaccttggcctcccaaagtgctgggattacaggcatgagccacagcgccgagcctcaggtagttctttagagcagtgtgagaacggactaatatgaaaattggtaccagagaagtggggcattgctataaagatacctgaaaatgtggaagtgactttggaactgggtaacaggcaaaagttggaacagtttgaagggctcagaagaagacaggaaggtttggaacttcatagagacttgttgaatggttatgaccaaaatgcagatactgatatgaacagagatggccaggctgacgaggtctcaaatggagatgaagaacttattgggaactggagtaaaggccactcttgctatactttagcagagactggcggcactgtgaccctgctctagagatatgcagagcactgaacttgagagagatgatttagggtatctggtgaaagaaatgtctaagcagcaaagtgttcagatgtggcctagttgctgctaaaaaactatgctcatttgcataaagaaagaaatgacttgaagcaggaatttatatttaaaagggaagcagagcacgaaagtttggaaaatttgcagcctgatcaagaggttaaaaagaaaaaccagttttctgaggaggaattctaggctgcagaaatgtgcacaaataaagaaaagccaaatgttaatagcacagacaatggggaaaatgcctccaattcatttcagagacctccacagcagcccttcctatcacaggcctggaagcctaggaggaaaaaatggtttcatgggccaggcccagggcctcactgctctgtgcagccttgagacatggggccctgtgtcccagctgctctggctccagctgtggctaaaaggggccaagatacagctcaggctattaattcagagggtgaaagcctcaagtcttggcagcttccatgtggtattgagcctgtgggtgtgcagaaggcaagaggtgaggtttagaaacctctgcctagattacagaggatgtatagaaatgcttggatgtccaggtagaagtccactgcaggggtggaaccctcatggagaacctctactagggcagtgcagaagagaaatgaggggttacagcccccacacagtctccactggggcactgcctaggggcactgcctagtagatctgtgagaagagggccactgtcctccagacctcagaattgtagatccagatagtttgcaccatgcacccagaaaagccacaggcactcaatgccagccagtgaaagcagctgcaggggctgtaccctgcagagccacagggtagagctgcccaaggccttgggagcctaccccttgtgtcagggtcgtctagatgtgagacatggagtcaaaggagattattttggagctttaaaatttaatgactgccctgctgggttctggacttgcatggggcctatagcccctttgttttgggcaatctctcacttttggaatgggatcatttacccaaaccctgtccccacattgtatcttggaagtaactaactttttttttattttacaggctcatagatggaagagacttgccttgtgacagatgagattttggactgtggaatttcgggttcatgttgaaataagttaagacttggggaactgttgagaaagcatgattgtgtttcgaaatgtgagaaggacatgagatttgggaggggccaggggtggaatgatatggtttggctctgtgtatccacccaaatctcatgatgaattaccacatgttgaaagaggcaccaggtgggaggtgactgaatcatgggtgtcaacttccctcttgctgttctcatgagttctcctgagatcctgttgtttgaaagtgtgtagcacttctccctttgctcactctctctccagctctggccatgtgaagactgtgcctgcttcccattccaccattattgtagtgtctggaagcctccccagccatgcccctccaatacagcgtgctgaactgtgaggtgactaaatctctttttttcataaattacccagtctcagttagctctttatagcagtgagagcagactaatacaattttctaccattaaataatgccacttcacatacattttaagaaattcagccaggcgtggtggctcacgcctgtaattgcactttgggaacacaaggcaggaggatcacatggacccagaagttcaagaccagcctgggcaatacagtgagacactgtctctacagaaaaaaacaaaaattagccagatgtggtggtgtgcacctgtagtccaagctactgagggtgtggaggtgggagaattgcttaagcccaggaggtgaaggctgcagtgagctgtgctctcaccactgcactccagcctgagtgacagagcaagaccctgtcttaaaaaaaaaaaagaagaaagaaactcacaaaagtatacttctatttatttcctcccatactttgtgctacgtgggtcttacagtctgaacatttgtcctctcaaaaactcacgttaaaatttagtccttaatttggcagtattgaaagttggggccttttagtggtgattgagtaatgaggactttgccctcgtgggtggattaatccatcaatgggttaaccaatttatggattaatgggctaacagattagggcaggggtcctcatgccccaggcctcagaccagtactggtccatggccttttacaaatcaggccacacagcaggaagtgagtggtgggtgagagcattattggctgagctccacctcctgtcagatcagcagcagcattagattctcataggagcaacaaccctattacaaatgacgcaggcaagagacctaggttgcacgttccttatgagaatctaactaatacctgatgatctgagatggaacactttcatcctgaaaccatcccccccggcccactccatggaaaaattgtcttccacaaaactggcccctggtgccaaaaaggttggggacggctggattagatcatcataacggtggggctggtggctttataagaagcagacttgagctaacacattcagcccccttggcatatgatgctctgcactgccttgggactgtagagtcctcaccagcaaaaaggctctcatcagatgtgaatccttgaccttggacttctcagccttaaaacccgtaagaaataaattccttttctttataaattacgtttctggtattctgttataagcaacagaaaactaagacagttgttaaatcatttacttctacaaataaaggttgaatatcccttatacaaaatgcttgagacaaaaagtgtttcagatttctttggattttgtatatctgcattatatttactggttcaacatccctaatttaaaattcaaaatccaaaacgctcaaatgagcatttcctttgagcatattcatgctcaaaatgttttggattcttgaccattttggatttcagattagggacactcaacgtttattataaatcctattaaaaaaacctaattattcttgcttttataaaatatcttttaaagagatttttaagtaagagaaaaatccttctatatcacgtttactatttgttgtgctcttcttttttgtaaatcaaaatttccacttggtattgttgtccttttttttttttaacacttttttatactacaggtttactgacaaattctttcagcttttgtgcacctcaaaaagtttttatttcgccttcatttttgcaaggagacatatcttgcaaaaatgaaggcgaaataaaaactttttgaggaccgagaattttaggttgacaatttttttttcattcagtattttaaaatattgttccattgtcttttagctagaatagtttctgatgagaagtctgctgtcattattctcctatataaaatgtctttattttctctggctacttttaagatttccaatttatccttcattttcagaaactgtagtatgattttttcatatttcttcatttatgacctgttgagcttctctgatctgtgggtgtattgtttccacacagtctacaaagtttttagtcattatttcttccaatgtattctgtccccactcctcaggtttcaagtacacataagttaaaatgcctaatattgtcctataggtcattggtgttctcttcctcctcctctccaactcctattccaaaggccttttttagtggtatgctgttaaactctccagtaaggatagggcagtataaacaaaaagcctagtctagtgtttaccaacttccatgatgtaagtattcacataaatagccaatttcaagttactaatggtttaacaaccagtttacaaaattccctaatatttaacaaccagctcttataaacctggacaggccatgccagcccaccactgtttttttttttgtttgtttgatttgagtaatttatattgttatttcttgacatttactgatcattttaatgcactgtccagtatgctaattgcatacagtcaatttaaaattttgaatacttttatttttttaatctgtagaagtataatttggtctttgaaaatatgttctatttctttcttttacatcttttttatgttttcctattcctctcctagagtctgtttctattgattgacttatcttttggtaatgggtcgggttatctttctttttttaaatgcctggtagatttgactgaatatctgacattatcaattttatattgttggtggctggattttgttgggaatcctttaaatactgctgggctttgctctgggatacagttaaatgacttcaaccagtataatccatttaaggctttttttttttttttgagacagagtctcactctgtcacctgagctggagtgcagttgtgagatttcagctcactgcaacctccacctcccggcttcaagtaattctcctgcctcggcctcccaagtagctgggactacagctgcctgccaccacacctggctaatttttttttttttgtatttttagtagagacagggtttcactatgttggccaggctggtcttgaactcctgacttcgtgatcagcccaccttggcctcccaaagtgctgggattacaggtgtgagccaccacacccagcccatttaaggctttttaaatttagttaccccctgaaaacactagggttctaaacttgtttttgacacagccaaggtaattacagatttataagctaaatccaggccagcacttatataggtgaatgaacacatgaaagatattattaatacctaggaaaccatgaagattttctacccttttaaaatcaattcactgcacaaaacaaaaagtttgagagaatgtaattcataagatgaagaagctatcacttctacaaaagaactattataaaaataaagtgagagaggataaaatcaagataatacggtatacacaataaaagtgaggaaattttggctcaactatccccttttaaaagaatgtatacgcaacttcataaataattatagctacaatttgagtgcttactcttaacaatttatatttatttgttccagttactattgctgagtatcaaaccactccagacttagcagtgtaaaataataagcagtttattatgctctgagcccagtatattctctttatttatcaagcccctcttatctaattcctgatgctttgattccacaatccatcacttcaatcatcacccgccattttcatgtacttcctatccatacacttgtctggtaaaactgcaggcactgttcaaatttagtgaactttacttccataattataaccaggctattgaatactgctggaaaaacctgaaccacttcaaagacagtgtattagtccattttcacaccgctgataaagacataactgagactgggcaatttacaaatgaaagaggtttaatggacttaaagttccacatggctgtggcctcacaatcatggtggaaggcaaggtggagcaagtcacatcttacatggatggtggcagacaaagagagagcttgtgcagggaaactcccatttttaaaaccatcagatcttgtaagacttattcactatgatgagaacagcatgggaaagacctgctcccatgattcaattacctcccattgagttcctcccatgacacacgggaattttgggagttacaattcaagatgagatttgggtggggacacagccaaaccatgtcacatgttgtactgttacctttctaccagcattctaccaaaaagccttgctcgctaccttactactaataaacttttaaatacctttttgataagcaaaaatatcttggtattccaatctgaatctcttttaaaatattactacattttattagtcaatgttattttctcttgtatctggttttattttttcattccttttgctcacttagctgttatcttaatatttatgacatcaatttatgcaacttctttacaagttaacaaaagggatgaaacttactcataattttgttccaaggattataggataattataaaatactcagaaggtccttcttattccacattatgtagctgctcaataagtattagcaattattatcactagctatatgtaagactattaatgctatgactataaaaatattacatatttttctcagtgagttggtttttgaccaaaaaaaaaaaaacttatacattagatttattcattcattcaacaaatacttattgagtcttctgtgtgcaggcagaaaatgctgtctttatttgggaggtcttttatcccttttaagaacagaatatctttccacactggaatgttaaaccagccagccatttttaatttcttatggaaatatctgcctattagatttttacatttaagtttgttagttatctgaaatgtaatttttagtttgtgagataaaattccttccctcaaaagctaaagcaacctaacaataatatttattaattatatgtacaatttctttttttttttttttttaagacagagtttcgctcttgtagcccaggctggagtgaggtggcatgatctaggctcactgaaacctccacctcccgggttcaagcaattctcatgcctcagccactcaagtagctgggataacaggtacacaacatcatgcctggctaattttttgtatttttagtagagactaggtttcaacatgttggccaggctggtcttgaactgctggcctcaagtgatctgcctgccttggcctcccaaaatgctaggactacaagtgtgagccactgtgcctggccttttgttttaaatatttaaatatttcagttaatcttccttttgtatttttctgcattaactttagcctaattttgcaactaaagaaatcatccactggaaaccattacaattggattaaacctaaaaattaatctggaaacaactggtatatataaagtgcaacctatgtgtaatatctactaataaattttttctatttgaatctgtatttttggaaaatttacttttaagatctttcaggacttttgtagtttctatgtaggtgatatctatctgttaatttttgtatttttctccaatattttcttattgtttctagctataatctttaattttgtatacttattttgttcacacaggttgattcacataggttttctaatatttgcattcaaaccatcaataatgatcatttgttctcctcactaagtgtcacattatttgtccacactgtacactacacactggcataacagggagcctgttatggctcacacctgtagtcctagcattttgggaggccaaggcaggcacatcaccatagaatcagtaggacctggattcactattattagttatatgatcctgggtacatttcttaacctctgtgcctcagttcttcagtttatactgattttataggatgcatgtgagaattagatgagttaatacatgtaaagcacttattatggtgcctgctatgcaacaaatatggacaaatacctattgaaaaaagctatcatatctttatgtttcatgccttaacatatttacttcaagattattaaacagttacgatgaaaagacatcttcccttgcaggtcctgattttaaaggaagaacctgtaggctaggtgtctccctttccaaagggacccatggaaaactatcgaaatcatacataatataccatgtatactgtggatttaaattttcctagaaccccacagcatgctctaggtttgttgctcacatgtatggttttaacacacatgaacaccaatgttctaaaaaatccattactatcctatttccaattaaaatatgatagcttttttccttgttatttttatattatatggttttattcaatttatttgcactaacatcttaatattgactgatatccaattattaagcagttcttggggggaactatctggctgagataggttattcttttaacaagattaatttcaatgtgttcatatatttatatagagttttttgttctcaacacacattcataaatgagacagctataagtttcttttcaggaagaaaaacatagacaactgtctatatttttgcacacttttacttttaaactttatgtcattttgtttaatgtgtgaatcttgcaagtaaaatacctgatattttattttatttattattagtattatttttgagataggatctccctctatcactccggttggaatgcagtggcatgattatggctcactgcagcctcgacttcccaggctcaagcaatcctcccacctcagcctcccaagtagctaggactacaggcgcatgccaccatgcccaggtaagtttttattttttgagagacaggatcttattatgttgcccaggctagtcttgaactcctgcactcaagcaattctcccaccttggatttccagagtcttgggattacaggcatgagctaccatgcctggtcctgatattttaaaagtctatttttgaacccactttttaaaataggaagcttaaactatttacatttattgtcatgactcagtttgctcttacttaaatttcttatttcattacattcttttaaaaaaactcacttaatttttttaactctgacaacttagaaagtgtaataatctattttatatatatacttgttttatttatttcaaactctaggatgaaataataacttttaactatacgctagggacaagagtaatggttacgtgactttttcttcctaagctaggatgctttgctcaatctttgaaaacaatttggttctgttctctcacattatcatatacatatatctaatgtaaaatcttcaggaattattctggacatatataataattaagaaagttctacatatttaactgatttcaaagttcatccaatggtatttttggatcataaatttcccatcaaaaaaatttttaactgatacataatagttgtacatattttgggggtacatgtgatattctgacaccatatacagtgtataataatcaaatcagagcatctgagatacccattactccaagcatttatcttttatgttgggaacataaatcttctcttctggctattttgaaatatacaataaattattaactgtaatttccctactgtaatactgactactagaacttattccttctaactatatttttgtactccttaaccaacttctcttcatcccttcctctaagatcttaagatgttctattcttaaattcttaactttgattcatatctagaaatggtactacatctttaataaatcttaaatctttttttttttccagggagggaacactgatatttctctaataatgcacatatgtttacaactaccatcacaaatgactgacaacttaggtgaccagattcctcaggctacaatttttctcttagtgctctaaatatttctccattgtcttttggatttagtgtttttacagagaagtctcaaatgtactatatgtttttgtgtttaggtgtctgcaatatttgactcttaagatacaaacaaaagaattttctagatatagttctcatctcataaattttgcctggaatgcaggatgactcatctcttcagaaatctcagcaaggtttcttcatcatgctcattattgtttctgctccactagtactgtcccgggatacttatttgtgggtcaaatatctttctatgtcctcatcatttatttctttcattttagttttggtcatttcttcccacctcgaatttgtctcccacttcactgattagatttttccgtagtgtcaattccatcattttaggcctgagatatagttttaaggaagcaactgaagaacatgaactttaaaattgcagagactgtggtcttaaatcccacttatcctattttagactaaatgacctaaggaaatcacctaacatgtctgtttgtctgtttataaaatttctcatgtgcaaaaaaagaatcccaatatctatcttgcatgattaacatgagatttagaaataatatttgtaaaactcttattattgtgccttatatataactggaatataagatgaacctgccattattatgaatccctattttgacttttttcctcgcttaattttatttcagactgctccatttctcatctcagcctgttctgtacataggactccctgttcttctttcaagaagaagtcctatcttttcaaatttcattaaaatagataatattgggttgtggttaaggcagtggattctgcacttccactcagtgtttgaatcctggttctaccatttactatgtaactttcagcaagttacttaacttctgatgtagttttctcctgtacagaaataaaaccctgtaatttcgtcgtttgtattaaacgactaaatatatataaagtgtttagaagagtgcctaaagatagaaagcattaaggcatctagcaaatgaaagcagctattcctcttttacttcctcaagttaatcatgtcaaaaatattttgttctcctctaagtcctttagaaatattcctgttcttttgagctgcgaaatatcttcccaaatatttgttcctagtgtacttatttctgaaagaaaagaagcctattcagtcctggtgtttgcaaagagaggctggataaattatgcttagtcacctcacacttatgtgcccctcaacatttaaactggaccttaggtaaatggacatagcctctgcctattctgattatccatttaatttaaaccttggtctaaattgcattttgttcatggctcacaactcccagttctttaatactaagagacaatatgaggttcttctctgagcataaaacatctctgcagacaactgtttccagggttctttttgcttttgcccaacataaaccactccatctgaggggagcgcatatatcaataagcaatgtttcatcctccatgtcactattccctaccatattgtgcactagtaccaccagaaaaagcacatgctatttcagagcagcaatcactatgggagtgctaatctgtccattctgtcagtagttcgaaatttttgtgcagtcgtacaccagtgtatacactatgaaccctcacatatgtgcagctggattttggtcaattttactacttgtttttgcctcacttcagaatttatattgttacattgacatctgccagacagaatactaaaatgaacaggtcttaagaaaaaatggggtaaatcttactacaagcaaaatgtaggattataactcattataaaactcctgccaaaaaaaaaaaaaaaactatgtaccatttacacaagagcctgtttatttttttctgtgaggacagaagagataatggtcaaagtagtaaaaagtgcaactcaagtagggagataggtataaagagggcatagagcattaactgtggatgccaatacagactctttatgattccaaggggatcaggttgtagttagttgctgatttgcttagtctttgagcactgtatttttaattccttcaagtgtgctgccaaagattctatcatttgaaagtgtgcctcaaacataaaaggataattattaccatacggccattgatttctcctggttctgttgggtagaatcacacagaaatagtttaaataagcacaagctattcaatatctgaagttaagatactacttcctaagttcttcacaattctgggttaaaaatattttcttcaaaaatgttatcatggctagttttgagtttccccactatctctggtcattttccccactgtgtgtgtgttcttcctgtaggacagcactcaagaatgaagtcaatattctcacagtgatgttgattctaatataaactttatttttaccacatgttattgaccatgacatagtgttactgtttttaattttcaaaattccttagaattttaacataaaatgcagccatatctgcattttatgcgcatatgtaaatcactattacccaatgatcatttacttactgagatgttttcttcagacctgacaagttttttcttcagttttttcttttcacgcattagatcactgtgggtcttaagcaattcttcaaagcgaactttggtttttacttttgcttcactctcagctacaaaagatacagccatgtgattttgtaaatgactctatcataacacacaacctacactactaggatgttaagaaataagttcttgtaaatatcggcatgagttctctagctacattagaaaaactcacctatctttccttcttaaaatattttttattttgactttagtgacacaacattcacctgtatccctctgacctttttggccactcactctaaaagtctcctttgctaagttaactttttatttctgataaacagtagcatctaccactgttagttacgtgttatgtggctttagacaagttactcaagatctctaaacttcattttccttatctgtaaaatcacaattatcttatgccaaagatcattttgcatgaaaaatggctaaggtgtgcctagcctgtaatcagtattccacaaatattaacaggtttttcctttaaaacatgaagaagataatgcttaagcccctgaaaatttcccaatacatttaggataaaataagtcttttatatgccctacagggctccatacctcctgatctatctccagggcttcaaatcaagacaaatatccccttagatgcctatgttctagctataatacccttcctttagctcctccgtcacagcaagctccttcccacatgaagctgtttctgaggcaagcttcctctaattcctcacctggctggtgttaacctgtctgtttaaatgctgcctgtaaataaaacacctcctgacaaactcatctaattttcccttttctcacatagcaggttgttctcttccttcacagcactcaacccaaatggaaattatataattatttttatatctatataaagaaacatattttctgtttcccccataactacatccccagctactattatgaggtctgacatagtgtacatagtcattatgttttaaattaataaatgctgaatgaatgggtgctctagagcaagtgtcggcaaactatggcctgcaggctagtcacttgtttttgtaaagatttattgaaatcagacatacccatttgattaagaattgttataactgctttcatgctttaaaagagacagagagacagagttgagcagttatagcagagactaagcctaaaatatttactagctagcccttttagaaaagattgccaatgcttgtggtggagtaaaacattcaattttgatgataaagaataaaaactaaccctatgttgtaatcattatttaccttgtccatctgagtcccaaactaccatccattaaatacatactaaccttaatcacaatattaaatagaaaactgaatacaaaaccaataagtatctctaaatgtagtatatttggtcaatgacatctactgtattcattaatctgttcaagaatcccttaaaataaaccaaacttaaaagtaaatgtataaaatataaattttatacataaatttcatagaagtcttacctgtaggcatctctcagctttatgcagaggactgagaatgcaaagcattgactcaatcaggatcctatcgaaacaaaggagatgtatttgtaatatggaacttccaaataaaaattataaaacgttcttcacacaagatcatgccattgtatgtccactacttcattaagtttataccaataaagctatgttcccttaacccaatcttatgcaaatgacttgggtacatttgaatcagtttagggctctaaaatcaagggaaacaaactagatcatatctgaataaagtatttatatatttgaaacaaaaaaaacattttgaaggcagtgcacatctaatgtggtatgttaataaactttttaaagtgttttaatacattaatgaacatttcaacgcacttttaagaaaccaaactccatctcaggattgactttcctaagagcattcaatattacattaaagcatgcttgtgggtagcacactcacagtgaatttaaatacctctgtgtctgccactgaaaattctgctacaatagagaaggatagtacaaatatttgcaccatctttctttaataaaacctggatgtgtattactgtgtcagaactactcaaaaccatggttcaactcagtatgtatattactaaattgcccattttattaaaaaaatcggtgtatgtctaaaatgaacatattctcacattagaacatttagaatgtaatatgcatgtttttgagactaaaactgaagagtgttaaaaaaaaagctggttcaggaattattgatttgtttgtttttgagatggagtctccctttgtcgagtgcagtggtgtgatctcggctcactgcaacctccgcctcccaggttcaagcgattctcctgcctcagcctcccgagtggctgggattacaggtgtgcgccaccacacccagctaatttttgtatttttagtagagacagggtttcatcatgttggccaggctggtcttgaactcctgacctcatatgatctgcccgactcagcctcccaaagtgttgggattacaggcgtgagccaccacactgggcccaaggcattattggttaatgctccaattccctggacatccacattcatgttcctcttgcagaaatgtctaagaaattctaaaaagaaaggaatgattatgtaaacatacctaactatgtcagttaacttaggcaacaactacgtggcacccagtcaaaacagacatcactaaatccatggagtaaaaattcctatactttagtgataggagcctgtatttactccttctagcagttataaatttaataaatctagtcttctactttctagtctatattaaattagaaaagagaagctgcaaaggcaagtgcaatgacagcatgagtaattgaaacctgagagcacggaagtagaaaaatcataaaacaaataaaaatttaatatttatactactcgatggtcatctaataggccaggaaaaagctgacctatattatgactatgattcatcaaaaaaaagcctgctgggcgccgtggctcatgtctgtaatcccaatacttgggaaggataaggcgggtggatcacttgaggtcaggagtttgtgtcctgtctggccaacatggtaaaaccccatctctaccaaaaatacaaaacttagtcaggcgtggtggtgggtgcctgtaatcccagctactggggaggctgaggcaggaaaatcgcttgaacctgaaatgtggaggttgcagggagccaagactgcaccagtgcgctccaggtgatggagtgaggtaatattttagaaagattaaataactaatgaagaggcaggagaaagaatcggagataattcccatgtttctagaactagaataagtagattagtagtatcattacactgtaatataatgcagtacagggcagtagtttaaaatccatgtcctagaattagtttccatagtcacttgcgtgacttttgtttcctcatctataaaaacaccctaccagtgccgactcaaagggttgttgtaagggttaaatgatttagaacagtaccgtagacagaagaagcaacaataaatgttagctataactgtaacaggttgttagggtgcagtcactgagcttagtatgggtcatgttgagttgggtatctgaagggcactgagcagctacaagcatcagctccattttcagatccttggatccaaataccagttctatctgccagcagattcacctctatggatatcaacttcctaatctttcacaataataagagtaaatcactcacagtgtttttataaagattaaatgagaatatgcaaataaaatactaggcacaatgcctagcacatggcaagcccttcaaaaacaacaactgttattactgtcacgtgtgtgtgtgtttacgtatataatcatattatgtttgttaggcaatctactaatccagcagggagacaataggctgaagatttgggagttatttataaatatgatagttccaagaaaataaaaagccaatgagaatcctgtgagcctacaatataaagtaaaatcagggagataggtgaaaaactgggagatagaagcattacagaagcaaacccaagttttaaaggagatgttgcctatatactgtgtggcatcaaaaggggctggaggttttgaagaaagtccactgaatctgcaagtaggaagtcacgtgtgtcaaagctgtttatagaggggcagaaacttagcaggctggggctaaggaatgaatggaaggtgacacctgtagaagggacatgtagacaattctttacagaattcttccaactgtcttcccatcacccccaaaggcagtgacatgagacagtaactctgagggacaaaaacactgtggaaggattatgctttttgttttaagattgtttccacgccgctatcacctttcccttaaaaaaaaaatcatcatctacacagcaactagtgtaattttctaaaattcaaatgtgatggtgtcgtttcttcgcttaaaattcttcactagctcccaatcgcacattgaaaaaaatatcaagtccttaccagtgaggtccaaggccatttatgaaatgtccccttcacacatccactgtgttccagacatgtgaaactacctgcaggccttcacgtgtgccaagttctctcttgcttttgtatcattacacacatatcccctcccctgaaaaatgtgcttcctcctttgtctctctaacaaactcctcactatcctttaaaggcaaatgatatcttctctagagagcattctcaccttgaagggcatttaagaacttctcttctgtgcttccagggtgccttaatctttgtagctccctctacctcaaccttgaattttcaccctggtaaaatgttctgtaactcccaccaaactgctagctttggaggaccaagccaatgctctcttatagttatgtatctgccactatgaaagaaaagagaggagaagaagagagaagcgaagtgaagagaagcaaaagcaaagcgagtaaaaaagactcaggcttgagctctagtgtcaccacttactgatgtgtggccttgggcaagctacttaatttctaatccttggtttttccttgtctgggaatttaaaatggcacctattttagtactgtaaggagaagagaaaataccaaaaagcaaagtaatcagtacattgcaataaaattactttatgtccattattattgtattaaaaataagtaaataattacaaataaaatatataaatcatatacttatttactattaacagcttaatacacaactaaactaataaatactaatattatgtaatgataacacagcaaatacagtacagaaatcatctctaattttttttttttggagacagagtctcgctctgttgcccaggttggagtgcagtggcacaatctcagctcactgctgcctccgcctcctgggttcaagcaattcacctgcctcagcctccctggtagctgggactacaggtgtgggccatcacacccagctaatttttgtatttttagtagagatggggtttcaccaacattggccaggctgatactgaactcctgacctcaagtgatccacccactttagcctcccaaagtgctaggattacaggcgtgacccactgcgctcagccatctctaaatcttaatatgtactacagcaaacatgatagaattaacggctaatatttgattagtaacctctgcaaaaaatcagataggactttaaaagacacctctgattcttatatattccattattttacaacttctccctcacaaaccctttcacaggagcgtctaagagatattacacaggaaaattaaatggattacatttcatctcattttattttacagacaacctgattatcagccaatatgtggctcaatatcattgggagaaaaaactgagaggcttgataattcgctccttaaccaaatgttatcgcaagggaaaaaaagacaaacaaaaatcctgtatacaaaattcaatgaataaatcaacaagattcttcataagtaaacaagattctaacttcataaatattattcctcataaacaagattctaggtatggtttaaaaacacttttggtatttgaatttctttcaagcattctttaaaaaatttcccagagtactcataagaagcaatcttcctcctaacgcccaagcagtaacagcaactgttaatgcaacaggtgaaaaaatcgttggcatctctttctcaaaagaaaggggaaagctttattttcacaatagatgtttttacaggaatgctaaacgcagcacaacctttgataaggattcttaaatggtctacatttttgttctatttttatgcatctcgaaacaaccctattaatataatttggctcttataaatataacaaattgatcaccttttctcagacataattaagaaggctttgacaggttgaagattcagccccaggttgacactctaaaaggaaataaacacactcagtacacatctgatttaaaagcatttaaataagaatcgggagtaggaaaggcaaagattgaattctctatcagagcaccatgctcaactctccggggacacggagaccagtgaaagaagcgcaaaagtacggtgaggactctcagaaatcgcattcccccgggacacccggcccacgctcgtcggtcactacgctatcagcctccgcgctctcggactccagcagccccgacacgccgcccaggagagggccgggcaggccgagcaccccggcccgcgctcccgccaccagcgcacccatgatgtactcacggagaggggtacgcagaaccgcccgtcccgccggagccgacacccggagcagtgcaaatcaactcccccagcctagcggcgcgtgcgcgaagtgaggcggccacgcagccacctaacccgccagcgacccgtgtcctgaaagcaagccgcggctctgtgccgcagtgcggacagcgcgccgcc

SEQ ID NO: 2618 - DNA, 213795 bp, Homo sapiens; identical to SEQ ID NO: 2614

SEQ ID NO: 2619 - DNA, 275750 bp, Homo sapiens
tttgctcatattttttttttaatgtatcacaatgagcaggaaacatacttgatgaaatattttcaaaggagtatattcaattaccatctacaatcaacttaactatgacaacaaagtttttgtgacaaatttttttttcagtttgaaagttccatgtggttctgtttgttagtctccatgtattttggtacagttcgagatcagcattgttacagtaacaaaaaagctaacaagactacattatagaaaaacaccaagaacatcatttttggtttcacttgctctattttttttgttgttttttgtttttttttctttttgtacattgcaaaggctgttcatatacctcttcacctcagggtcacgttcatttatgctttctttcctacccaaacttgcccccctcccccctgaagaaagtaaacaaacaaaaaactagtcaaagctttgtttcacagtgggcagtatctcagcgccaacaaacaactcaatttatgcttctatttaaaatgttttaatttattatttaaaaaaaatatatgtccatgaacatcaagtgcactggcttgggtcactgcctctctctcctgcaacttcctgccatgcctgataaactcaggtttaaacacatgccgtctgttttactttattttcaattgtgtaaaactttggccacattcatctctttaaatagcttgtaattaaaaaaaaaattcctagatgtattaaatttttccttgtgtagatatgtggtttttggaaggatggaggaaagatggatgaaataactcccattctgtgggtcagactggtgtctagcaccaacccacactatagggagaaaaccaaaaaacgagtgtcaatggaggtgaagaactaatttaaaaagcaagtggaaatatatcctacccagctacctacaatgcagcagacaggaataaattccccaagtgagataaagctaaacaaacagttgagcattgtagtgaattcatgctttgtaaatagtactggtcatagccacgatggctgtcagcccacaaacatctaactcatgtttgacctctaatgttcaccatcactgactgctttgctacttctgggttagtgctgagaattattcttacttttttcaatgaacatatatgtgggcggtttagttgcagaggaaagcattaagggtgcaacccactccaggttgaaacaatcacataacccctctgagaacactaggtgggtggaagtgtgctcagccaatctattcaaccaccttattgtcgccaaacacccacagctcaaggcatggcataacaaaacactgacagtcactctgcctcacagagggaggatggcatagtagctccatgaaaaaaaaaaacaaaaacaaaaacaaaaacccaaaccatcagggagggggcagcaaaattataaagaaaagaacttaaaagttgaggggggagggaaaaggatagaaattgcactattaccaagcaatatcatttttaaaaacaacgttttcagagaagacctagcagaatttgacaggtaaagctagtgttacattgttaactgatatcacatagagaaccaaaaacaaaaacaattttttttctatatggtacagacacagagtaacatacaacagttaaatggcaaaaaatatatatatatatatttcatagagttacaaacaagataaaataatggaaaacaaaaaactgtacaactttaaaatttaaaaatgttcatctcaaacacaggaagaaatacaagatttcttgttaaaaggaaatagcttgttaaaacagtaaatgttttgcgtacttgcttttgacaccttatgctacaactggatactggtatgaatagttagatggtattctttctttagtatttctacttaaaaaaaacaattaaaaaaggaatttgcactgtgcatcagcctagttagaaatatgtacaacatttcaggatctactatttcattaaactaaaaacaaattcataaaaataaaatagtcccggctaaaaaagaaaaaaagaaaaaaaatccattttcagatcttggaatgctccagtcttttgcaaagtcgatgagtggcttcagcactggggaaagaagcccgaaaggtgaccaatggaacctgtattcacagtcttcaaagttcccttttgaaacataaggaagaaaacgaagggaagaaggatttcacactttgggggcaaggggagatggtttctgttgatgtttagctatgaaagtgaaacagcaaagcatctatttatttgtctccaaaatctatgttttagcagcacaaagttttcaaagttcagaccatttatttatttttctttttacatgagaaagggtgtgtgttaacaggaatatggatattaacagaaacaagtgcctcacatacagttccttttttgctttctgtacactgctatctgctgctttgttggctgcgctctggatcactcgctgctcagactgcctaacacaaggacaaaactttgaagtaaaaaatgtgtcttttggtatatggaattgtcattaacatttgcctctctgcttgcagaagaagcacataacaacctgggaatcttttgtttttctctttcttttattaaactaagtcttgtttgtttaaatcagaaacaaattctcaagtaacaagaaccctttcccttttttctgcatcagcagtgaaagggtgtgtctttggattttatttaaagcatgaaatttttttttctgagagaggaaagaaaaaacaaacacaaaaccaaaaaccaaatccctaaccaaaaactttttttagaaaagaaaagtacacagccaattacacaaatggaaacaaatcctttagtatagaaaaaaaaagaatatttgaagctcctaccaaacaaggaggaaaagaaggggtacaaagaaaaaaaagccaaaagaaggataaataaaaaataaatgcacaaagctaacagacacaggtaactagaattatatgcctttaaaaagtttcaactccccaaccaaaaataatctgtgaggatcctaatgacccctagaatcccttgaaattctttctttagttttataaaataattctgcagctccctctaagaaatgaaggcagctaccttaagtgggagattataggacgggaggtgggagaaggaaagagaaagtggaattaagggacaagaaagagaaagtggaattaagggacaaggggagaaaagcttaggcgaatcaacggattgcaatctatcatctgctaggaatgaacaagacaacatcaaatgaggagctgtcagctggaccatacaaaaagctaaatgtacacaaaaggtttttttttttttttccttttaaatctaccatactgcttcagttcatttccaatgcaacaatctactcaacaccaaaaatggtcatatctatcataaatacagaaagtcagtttttaaaacttattttttttaagctacaagtcctcaacactctttgtgtgtgtgggttattatttttttttttttttgaaagtgggagtgcttaacttttccccttgaaattggcttcagcagaaaagctatccttaaaaatccccagaaagctaaagcagttcacattgtttttcttgaatactttctgcccatttttaagttaacaaaacaaaaaatcttttctggaacaaaaaaaaaaaaaaaaactgaaaaaacaataatatataaaacaatgattctgaaaacaaagtgtgagcgattgacctgagaataaaaagacattacatttctttttttcttttagcaagccattggtatctgaatgctaagatagcaagaaatttaaaactgtaacaaggtggactgctttcccatacagtgcatgccgggctcctctgtgctatcagcgtggggcgtttattgaaaaggggcaaatatacaaggggtttaagctccaaagacattagggaggccctgcggacttctgtttcccagaccaatagtaccttcaaaaggacacaatgtaacagggttagggctttttttttttttttaatattaaaagaaaagaaaaagacaagaatgtaaaatcaccggcatagataggtatatgggaaaacaacccacgctttttcttttttttctttttttttttttttttgttttttggttagaagctttggaattgcagttagtctatttttgaaattggtttgttattaatttttgtatttaaattcatttgtttgtattgttcatcttcaaagcttacaatctgaaggtgtccgttcctacactggtcagaccactgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgaggtaaccgttgaagatgaggagagaggaggaaaagaagggggcttcgctgccgaagcccgggagaccacttgcggccaagacttcctggaggcgtggggggaagcggaggagggggcggcggccgacgggggaggggggctgtcgtttgagtgagcggcagactgcgaggtagatgcggtgctaggatcggggaagcaggcagagtgaggtaataaactagggtgctctttggcgtttcttgctgctctcgtgattgttctgtgtttgtgcaaggccgactcgagatgttgactcagagcttcctccccacagagcgcgctctcgcacgccaggcagtggtacgagccgccgccgccgccgccgccgccaccgccgccgccgccgccactgccaccgccgccgccgccggtggggacgtgaagcaccatctcttgcaggttcaccacagactggccgaagaagcagagggacttcaggtggctcctcgctgcctcctcgtcgctgaagcccgcctggcacttgcggcagaccaacttgtactgcacctttggaacaatgaaggggtcgtagagggagtccgcacttttgctttctgcttctggctcttcagggagtttcggcaggaggggggacacctcacggggggtgtttttctgttcttctggtttgggggattctttggcagggtctttgtctggggaaggagccccgggggggactggggtttggcttgctttgggctgctgctgctgcactttttgctgctgctgctgctgtagttgccgctgctgctgctgctgaattgcctcctgcagactctgctggtattgctggtactgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagcggggctgagatcgtggctgcagttgccgtgggggcctctcctttctccttcttggggacaggcaggggttcccctttccctttgtgtgccttttccttctcctttactttctcactgtctttgtccttgcgttgctgctgctgttgcagtgggagctgtggtgtgggtggcggctgggctgctggcggcgggggaggctgctgcacctgtggttgctgctgctgctgctgctgctgggggggttgctgagggcccatcgccatcgtggcttgtgctggggttggggagctcagcgacgctgaggacggtttatttggtaatccagaagtggggaggccaggggaaggaacagttgtgctgggcagacccatcaagttcggcttaggagacgttaaagctgaaaggaatggagacagaaatcaccggtcagtctgggcaggggtagggctgaagctcaagacgttttaccggtgtcactggcacacagtttgagatgtcaaggcttgaaggatcctctcaaaacgaacatttccaacagaagtatcccaccaggctcagggctggacaaccttgtattctaatgaggactcagtcctaggtcagctcccatacttcccctttcagccaaacaacttccagaagtatcccaccaggctcagagctggacaaccttgtattctaatgaggactcagtcctaggtcagctcccatacttcccctttcagccaaacaacttccagaagtatcccaccaggctcagggctggacaaccttgtattctaatgaagattcagtcctggctagctcccatacttccccttccagccaaacaacttccaacaccttcctgcccaatgtgccacacccgctagttcacattttctttgccaagtactcccagctaccattcactctgcccaactgcaattagtctagaggccccaaagctagctgtttctagctggggcccatttgcaccaaaggccttcatcacaaaaatagtatggccacgaggtccccagagaagttatctggaggagagcggcaacaggagaagagagaacgaaggcaagaaagctagcacggccacatgaacaaaaacaaaacaggctctacaggtgttcctcctctctgacctctgttgctgcagctgactggatgctttcggagggtagagagaagatgatgaataggaaagtgtggaggaagggcctgggaagaaataagaacaatccattcagggaaaattgcttccatgccttggcccagctgacctgcttcaacaagtctactcaacagtataaccgcctaggaataggaatctggaatctgcgggagaaacgaccatcttcttttcctgcccctgtttgaatgatacacaggagggccagtgggactgtagatggttgagaaacaaccgcaggaaaagcagaaaagccatgtcagaagtggaatagcccaagatactgacaccaattcccaagacatcacaacctacccgaagcaccactgcctatggatagcaaaggtctgaccatatcaccaggccctcatgggctagaatcccatccttgatcatacccctaatctaccaccactccctgcaacgccttcaccaacccgagagcctaataccctccctgacccatagctatctcctggtttgagtcaccaggtccaaggtaatgcaagagggtgttgctacggatggtactccaagcttcaggtgtgttgagactagcaagatagtaggtaaggacagcatgggggtggggtgcagtgtgtgctggacgatgaaaagctgagaaaacaaagaggaggatcccacaggcaacagctctcagaacacctctatattcaccatatccaagaaacttgatggtatatacatctcttcagaggacaccaaaatgcaaaatcaaaatcttacttcatctggacctcacctgctggaaagctggggaaggagttccataacatgacactgaggaaaaaaaagcaagaaaaagcactctgaagcccagacttgggggaagactgcagatttctggctatcatggtagtgttcaccatcaaaaccctcagatttcagacgaaaagaacaagactgcttcaaattgccaatcccagacaaacagctgttaatactggatagccaaggagaaaggttccttcagcatctcatcatgcagtgtcctcagtgcacataagacaccagagaagatatgtgtgactctactcagaaaagcttagtaaagacttgttggttaaattggcacaaacaagacagagtagattatgagttctaaacttgggacatggctctgtctccactaggcaatgggtctgctctcagtggggcaaggaaggaatatttagagatttccccatccccatggctccagacttctaggagaaagattcaggtcaaaaagccttaaactgtgtgtcttcaactgatggtctatataagaggttcaaattttaagaaacgtttacgaatctctactatttaccaagccttgcactagccatgctagacacagtagctcaacacactcacaactctgtgacatcctttttctgatctgtaagatcagaatcaggcaaggtacttcatcccccctagacttactcctacaaatctggagtcacactgaccctgtgggattatggtcacacacatcagacgtgtgaccctgggactttcggttgaactcttggaacctcagctttccataacagatggttatgaggattaaatgaaagaccacattgatagaaaaagcttagcattgggcctgacatataatagatgtttaataaacacaagtttgttccttccctcccattccagatccggtgtttttgagaactgtgttacggtcaggtgatgataactggggcatgtctgctgccctgaataaataagagcttatctttctatctcgagtccactctaagtggtcagaacttgagtagcactaaacatatacctgttgactgactggctcatattgggtgttgtggaaggagcacatagcacctgggagcccagaggcctgggtggaagctctggctcctaccctagcttgttgaatggtcttgacctctctggccctcagatttctcatctgtaaaacaagcggaataaatcatacattctgattctacttttttttcacattactatgatgtgttaagccttcccaagcccctctgccagggtcctgggctgcaggggtaattaaatgcttctctattttccatagtttgttttcctggcttatgtctagctggctttctgtgacatgacttgtcaacacatataagcaacaacttctatgtcttaatgctttcttttcttattctctttgaataagaaatggggaccaggaatgcagtggccttatgtttggtaaaacaccactcaaagtgtaaaatgtggaactaattcaaccagaaactaagattgctgtgggaagcagcacagctgctttaacccctgggaacagggacacattttgaaggcaaggtagcattaggaggggttctcctttggtgaactggaactaatcaattcaggccattgtggggggaatttgcagacttatgtctaagcctaacaggaccctggaggtgaaggtccaatttagcaaagatggctggatccagagaagatgtgaggacagagaaggagaaacaagagaagtatgtaggaagaactgcaaaactccctattaagtgagactataagagcaacaaatatgtatgattctcagtgatcaggagcaaggaaaaggaaatgggcaaaaggaaaaaaaagaggtgactgaggacctctgaaatgtgcatcagtattttaacagaaccacattgcccaatacaagattcctggtcagtgcactcaagtagaacggccatcttgttaaaaacagccactattgttctggctagaagagaaccccaacattaaggatctaccacataagaccttctggtagttcttttttttttctttttttgagacagtctcgctgtgtcacccaggctggagtgcagtggcacaatctcaaaccactgtctgcctccagggttcaagcgattctcctgcctcagcctcccgaatagctgggactataggtgcataccaccacacttgggtaatttttgtatttttagtagagatggggtttcaccatgttggccaggctggtctcgatttcctgaccttgtgatctgcccgcctcggcctcccaaagtgctgggattacaggcatgaaccactgcacccggccctgatagcagttcttttgccaccgtagctctctcaagaaggcagggaccccaggtgagggcaaagagttgatttaaatgctcttggaccagttttcttagggcataatccagaattagctaggactaactcaggtgtcttatatttacaacaaatatctagacaggatcagcatttccacaaggactgaatgaaagggtctatgataaaaacttgtttcttgaaatattccagaaattagtatgccaggaccctcaagtttttccctattataggggataagagtggtttcaaaggagactgttccgaccaggaggtcccatccctgacacaccagtacttgggagactcaacaggaacgaactgaagtcttgttgcttttaaagaactagaaaggtaagcttcccatctgcccagcactcagagggtttgggtggtatccacataacagaatgctgactgggcagctatttagccctgaaacaatcgcctagagcagaacccacctgtgttggatggagtaaagcctggcaaggaggggctgttgaggcccgggagcaacacaggaggaatgccctggagcgctggatatgctgtaggaaggttaagggcctgaagaggggtgttgtcaaacatcccttgctgctgagctgccagtccaaggacctcgttggcctttttaatccggtccaactcttgttgagccatcaactgacgtacggtggctgggtcaaagtattctttctccttgtccagctggcttccaatggtgtctttaactttggagatatgctgttgggaaaagatatggtcacgtacagacagccgagcgctgtacttgatgccacacaaagtgcactctgttttgggtccctcataactcgtttggtttataccaaaatgcttggccatgcttaacttggacttcttttcttttgcccgggcattctggaaccagacctgaacgactctctttggcagtccaatgtcattgcccaggacctcacattctagcatagtgggtgtcctgtagtcattaaagcatgacttgaggaccttcagctgcagattggtcatttgagtgcgaaaacgtttctgcccaggccgatctccgctgtcaccagatttgcctgcagatccactcgcaccaggactcggggagcagggatctgcaaggcttgaggtttcactgtagtccactgtaccttcattgtcatattccttgctataaaagctcggggccgggctgaccagaccagatgacaaccgatcttcatactcagacattgccatcatggccgctttggtcaacccttcgttgggtgcagaagaggatttggtttcagttgctattcccgttgcactgtcgttatctgcgttgccctcgtctccagttgtggtatctgtgattgctgtgttgacagaggaacagtcatcgttgtccagcttagtttggtcaaagtttagattaactgaggacatggaggggctttcaaagtcttcaatcccttccaccttaatggaggaagggcttagaagagttctgggtgacaattccatggttttactcacaggtgagagggggacaccctgaccatcactactgcttgggggtaggtgggaaaagctagttccgtcaaaaatatctcctttcatctggagtcccccatcacagtctaagagcatcgcagacagagttaggttgtagccagctctcttggcttcatgccagtgacgggaccggatatgagcctcaagagcagtcttggctttgaagagcgctctgcaaaaagggcatctcctgtgggcctgcgctgggcctacagcccggaactgtcctttcctttcccgagctcgggtgttctgaaaccagacttgtaccacacgtttcttcaagcccacctcgtgtgcaatgtgatccaacatctttcgagtcggattggaatccagtagatacttctggtagagaatttctagttgttccggtgtgatggttgttctcaaacgcttgtctctctgaggctcttctcctcctgtcccactgtcgttttcgccagggcttgcactggccttttcctccagcttcctcttgagagtgttcattgtggaggttggagttgaaggagaagtggctgagcttgctggaatctgaggtatggccccagagagcagctggctggccaggagtgggttactgggatcaaagagcatgaaaggcatatccagggacctgtccaaaaactgggggtggatgaactggttctgcgcgctcaggaagtggagctgctgatgctcctgccagtgctcaaatgacggaaatgccaacttacactggtcacactggtaggggattagctgaggaggtaggtttgcgagctgttgaggagttgatgtgtggaggggcttgaggggcaggtgggagagctgggaaggactggggctcgactggggtaaggggcactgtggagggggcgcttgtggaggaggctgtggcaacgaaggcagggacaccagctgggggagcttctgctggggagtgttggtcttctgctcgggctgctcttgctgctgcagctctggctttggttgtccttgcttttcttgggtttggtttggctgtgcactgggagcttccgccagctttggtttctcatcgcctgcctctgtttttgaattgaaggtggccagttcctcagcctccgctgtaagctgcaagaaagcggaggaagctgtattattggctgatggtgctggggcgctgtaagcctgtgagggcatcggggtactgcaggatgagctggtaggcgtcaggatttccatggcatccatggaatcctcattttggctgtcgtcctgcccctcctcatcctcatccttgtaacacagcttcttctggtgcttgatgagatcaaagatgcgctgaaacaccaggctacattttttgcactggtagttcaagttgcttgttcgaatgtatctatcatttgtaagctcacgccgctctccatctttgccctctccctgattctcataattcttcctggccttctgtcgggcattctgaaaccacaccactatcactcgggttggaaggttcagtaaattagagagttgctcaaattcatcatcctttgggtaagcattggcatcgaagaagtcctgtaagaccctcagctggtagtccgtaaaccttgttcttgaagacctcttgcttccccagtactcctgctttggaggttccggcgaagggggccgggagtcaatcttgagctcctccaggctggtgataggaggattactgaagttgtaaggggagtccttgttacgctgcctctctttgaagagagtgttcctgaaccagtgcttgatcactttctggggcaacccggacttgtctgccatctcttttatttgctcttcactgggggagttgttaatgtcaaaatattgccgcaagactcggagctgatcatctgtgatcctggtgcgaggcctcttgttctgctgctggagcagggttggattgagctgatgctggtagagttgggccaggtccgcaggcagaggctccacaggtcccagctgcgggggtagctgagccggcaaggtctgcagcggcatcgtctgcatcatcagcggcgagaagatgggcagctccatcggcatggagagctgggtgagcggcactgatggctgggccggtgcaattgtaggtgaggtgatgggtggggctgatgcggggatggctggtgtggacgccggctgaggcggcgctgccggaagtgggggtggagggggtggagggggaggtggtggtggctctggggtctggggcctcagtgggtacagtttatcgtagtggtctctgtactgtttggcaaacctctcgagctgtttgaaaggaaagtaattctgatgaacgtgctcttgatgactctttaaaatcaagatgttggaaaacaacttgccgcaggagtcacactcgagcttttccaggttctctccctggtcagtcttcccattctttttctgcaccttctgcttgttctcattatactggatgaccaactcaaagccaaagttctccagcagggccttggtggcgttccctctggcatctgaagcaatgcgtggagggagcatggaaggctcagaaccaccccctggtgccaactctttcttctctttggccttcaaggcatctggcagtgtttccttcggaccggtgttgccctctcccccctcggcgctgtccctctctctctggctttctttttccttttctttgatgaccaatttgttcttcttttcggggtgctggcttggctgaaggagggcagagtgactctgggctatagagagttggttctgctgctgctgcggcaagatctgctgatggctctgctgtgggacctgaacctgagccttcagatcttccagcaggcctgggcctgtcccagtcagtgtcagtgccccactggtcactggcaagctcacctcggggttaagctggaactcagcactggggatgtagaaagggaagaggaggtgctgctgctgctgtagttgcagcagggtctcagttgtcatggggaagtgaggaaggagggtggggttaaacagctgagactggatcagggcagcctgttgctgcagctcctgctgcaggtgagcttgaacttgagcctgggcctgggccagcgtttgtgcttgttgttgttgttgttgttgttgttgttgctgttgctgctgctgttgttgctgctgcctggatgcaatcatatctgccagtttcttccgattggcctctttgggctctgaaggggaagcaatgttggcaccaataggattccccaggggtggcatccctacactctcagtgggcacttggcttagtaagttagagcttggagcaatgccagcactgcttggattggaggtggtaaaggtgttactgccactggtgctcacaggacttggcgtggaggagctcaaggaaatactgctgctgttcccagtcccattgctgctgccacttgcagcctccagcttggctgcccgggccttggtttgatgtaacacagacctcatatggatctccagagtggaactctggctgtaggccacattacaagtgttacacttaaaaggtttgttgtctgggctgctggtgggttctggctgaccggttgctgattcttgaagggctctctttaacttatgcaggtgggagacagaattgtagtgtactagcaggatattcttttgagtgaaagattccttgcagacggtacacttgtaagggcgagaagggtctaggaacttttccatagtaaaattgggaccttttctgaaaggcagagctctctttggctctgagcccgagtcttcttgtactgacccagagtcactgcccgttgggctctgtttatcttccaagtcactctcttcctccttgtcttcctcaacaattatggtatggtcctctgccagagtggggtctcccattgccaggaggtccccattggccagcaggccaccataaagctgttggatgtcagcctcactcagctccaggtggcttgtctcaaggtgcttcttcagagcctggaaagttcggaaactgcgctgacaaagacagcacatggtggcagctctgatcacatggtactgagaatggagctgcaacttttcaatggtcttgaaggccaggctacactgattacagcggtacttgtacacatggcgatctgacaccggcagctgaggcctcttggcatgcacttcattaaaatgcgtctgaagggcagcagaagttttgaaaacctggttgcaccccttcttccagcagatgaagcctgagtcttctctcacagagcctgggtcagcaggggatggtttcaaatctccgctttgctctgtgcttgcggatggcaagatgttctttcccagatcctctgaggtttctgttaaaaaaaaaaaaaaaatcaaacccaaagataaagaaggctttgtttcaaggatggcacccagagcggtctacctagtcaggcctcatgaacacagaatctgatgatgagggaagtgcccaacctgaatgacagaatctctgcggagcgcctcctgctttcttttgttcctccaatagagcacatattataaacagggtgcacatgaacagagatggataaaaggaaatacaaaaagtttcaatgcataatagacccatgtcatatcacagatctaacagtcttttaaatagcatttaattgcttgactcagaatcctcaatttctcaagagctggtttgaaggttactgatcttagactggatttcccttttatgttcatcttttatgtaataagcatttagcacagtagatctgaagtgtagaatatgtgaattaatgctgtcctaagttgtgaggaatttacaagaactgctgaacatcgtaatataagaaatttggggatacatatttttaggcatttaatttcttgttataatgtgacttctgattgccatctctattcaataagcaattaacattcaagtgttcaattatttaaaatacatttttttccctacaatgagatcatcacactcataaataccgagaccctttaacaggtcatttgtccattgtctaatatggaaaactcacaagaaagagagaaggcaggacagtagtgtggccaaactcttcccaacttagaactcttcccaccttagaggtgaacgatgtaggacagcctcacagaggtctaaccattcatctagccaggaaacactatgtggcaccaactactgtctacaacaatgttctttccatcagcatctctgtgcttcatcctaagccaatcccaaaaaactcagaacgaaagacaactaatccagtgtacctaaaaatcaacccacaagtccctactaattaagtcctcagaaatacagtgtttaatggcttagaatggtagggcctactgactgagtctctggttattcactccctaattgtatagtttaagaagatgtgtgtgtctgtgccagaattccactggttctcatactaattttctctcactttaaaccatgtgagtaatatacaaatacatgccaagaagcagagtataaagtagctgatgacagtgcccctcatctcctgatcagttacattcaccttaagagtattgtaaagaattcctgaaaacctttctccatgaacattttggcattccatcttgtttcaatttcttggggtcaagaataatgatactgaccaggctgctttcctgcctcttccaaattggaattcccatctcgatctggaacagctgctgggaggaacatgctgcttggcatcaccatctcaggggtggtcacctgaggagcaagagcaaggagagtcaaatggagaggaaagcgacacaaaataggaaatgtttaaaaattatttaataagcaaaattagccttcaccagtgtaaagctagaggtgtctcacttttcatagctcactgaagattcatgtttattagacaaagctcacatcagtcaaaagtgtttctacggttacattctggacataattagcagtgcacacttgaagaataatcttcttattaatatttttcctttatgcagaattttgactttgatcactgacaatgttttgtcatgggctgtgaaacttcttgtgcaaccaattaggtagataagttgaaaggcccaccttaagctgctgaaaacataataagggccctaattaaatcatacctagtaaagtacactgtaatcttgaagcagggagcattgtagtactgttttcagaacgtattcaggcaagaggaggaggggagtaagagtgaaggaaagggtaagaagaaaagaagagaacaaagggaaggctagggacacgcagacatgctggcagattttccaggaaaacaacatttgtaaccctttacaagctgacatcaagcacaaacaagcctttttttgtgactcacttaagccacgatttcttctggagtctctgcccaaggtatacaacatcagagggaacttctgaccaacgtcccagcgatagagggtggcctgcacagcattctacaacagggcagccccaccttgaccatggccattttttctcaatacagcagttctggaaatcgcctggatccaaacagctgcaacttttgggcagagcctcagatatttctctaggcctccctgccgtacggccagaagcctgtccaaacaagttatcatttgccttatgttaatgtgataagcagccctcgatatccaatggaaagatcaaaggttcttcattcaaaaagaagcaatatccttttgcctgatatggggtgggaagggtaggtggcgatgatatttcaaatgaattagaaaccacctcccatttgatgatagctggagaaatggactgacctagaagttacaggaccagaaactacagtcaccactaacctttctacgtggcacccagccccacttggagacattatttttccatcaaacacaaccgtactgcacagacatcttcactgtctgttgcaaagattggaatacgtagatttctgttcaaaattaaataatattttaaatacattactattaatttttaatggtgtgacgatcccagccttgctcaaaatagctactgagatgtccactagaatcatcagcaataagcttgacaactagaggaaacccagacagccacccccatcaacataggataactcctcatcacacttaggggtattagaataatttcagcaacccagatgccagcgggtgcaaaaagtaagcaacaggtaccatggagaagcattctgagaaatgctgtgtttacgaagagcaggtgtgtggcaggtgaatgtgtgtgacatagcattcttgcccccacagacatctgcacctcacacaaagctcatcggcagctggttaaggctagctgttgatgaatcgttaagaatggagtggagattgccaaactcattccatctattttctttttaatagaaggcatttctgactagtgtggttggggagtccagcgggaatccgagaagtgaaaggtcaccgattaatttgtagtcctcagctgagggggagcacgaggttgggggtaagagggggagaaagggaaaggaaaaaagactcccccccacctcctttctcggttgtagctgcaagatcagtcctttcctgggatctttaggaattatgaaaaatgaatcatgagaaataaaaaaaaagccctacagagtaaaaaagaataaaattatctaacacctcagctgcacatcattatagaaaactgtgggcttttcatacacattacagtaaggcagacatcccctctaacagactcagtacgacggatcagtaattgttttcatacactttaattagaaaaactcagatggctatgaataataatggaaaagagagacttttgcacttgaaaggttgaagtcaatcaagtgtgaatgacggcaaaaaagaaaaaaaaaagacaccaattcatcagccctctgttgtctcgctgcgactttaatcataattcctgattgggattcaagaaggcagtaagcagcggttctttgtctgccttcaccttccatcaattaactctccccgaaatataatcatcaacctcacatgctcctctgcatcttaatctgggcctccaaacctgtaagtcttgccccatatgtgtttaagtaactacttttatccacctgcatttttctcatctatagtgtacccaacctctccctgaaaaaaagggggggttggtatatgaaattttgatgggcaagaaattcccaggaggcaaagaggaagattcctaaagagaatcctaaggatctggaaattcaggtggcgtctgtctgtgcatgtgtctcaacagaggttgagaatggaagctgccttgctacacaggctactggagggccccatgtcagttctcagacactaacgttccctttgcccattcttccctctcctaccagcttccaaagctttttactcaaagctttcatgctttatcttgaagagccataaacaatcctgccaacagagcccattgaggagtccttctgctcactgaggtgatatatatatccaaaggcagacttccttcaacacttgccttggcaccccctttgttttacaatcatatctggctactaaactgcatggaattcagactgtcccagccatagtctctaatggatagctgaaaatgggaaagtaataacccagctgtcggccgggtgcggtggctcaagcctgtaatcccagcactttgggaggctgaggcgggtggatcatttgaggtcaggagttcaagaccagcctggccaacatggtgaaaccccatctctactataaatacaaaaattagccaggcgtggtggctcatgcctgtagtcccagttactcgggaggctgagacaggagaattgcttgaacccgggaggcagaggttgcagtgagctgagattgcgccattgcactccagcctgggcgacagagtgagactctgtctccaatcaatcaatcaatcaatccatcccagctgtgctgagcacaggtaaagaccttcccttttgccaggaacactgaaacatgtaggtttatgagaagacaaaacctggttgtagcataaccagggtcatgccaagtgtgccaaatttcagaggccctcaaataactggtcctaccaccaattttcctgcagaacaatatacatgctttctctctgttccttcttcccctctctggccgcaatcctacaatgtccatacttccagccatggactcaagagccaaacgaaaaaagttctaaggtttggccaggtgacagtacaaatcagcccaaacacctacactttctacattgaatgtaccatccacattgattattccgataatccatacatcaataaacatttaatacattaaattatatcccccactctattcactaatgaacctgagaagtaatgagaagacaaaagtttttctggttaagaaaattcaactgattacagccattacagcattttgggtctctcaaggttggcctctgccatgcaaaaggcagttccatggtgatcttctagacaccacgttttcctcccaaaccttctgagccagttcaactaccttcctcccagagtacatgtacatttcatggaaacttgggaagaaaccatcagctgactggggtgcagaaaatttggaagccaacagtggctctgatatattcctaacaaacaggttttcatgcataacaaaagaaatgtagagttctactccagtgctcaaaacctcccagtttaagtaattttcatatataatagaaacagaagcgttccacattgatgctaaaaatgttcaagcttaagcacttccaaaataacacagttgaaaaggagtagccttgagaaactctcagttcattcaattgaccaccatttactaaataaacactgtacaggatccatgtgctgcatgcttctgagatgcagagagccagacaaaagttcctgtctccaaaaggcttatgatgcagaataaataaccctttagaggtcacaaaagccttagaaatctaatacaagttgcagactcctaggaaaatactttcacagaaagaatattccagataattttaggaaattacaagctccccagaaggaaatccatgtactcaagtgaactgcccttgatctactaggagaggtaacatataggttcataaatacatagttccaagctcttcctagtttggttcattattattttggattatgttctaatgcttttcaagattctatgaggtgagtggaccctaaagcctcaagggcacaccttatacagcccgtgtctgagatacgggactagtctcccactctgacatttgggaggggctgctgaaatatataatttcttggtagaatctggagttataaggaacaccatcctgccacttacgccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagattttatttatttatttatttatttatttttcagagggagtttcgctctgttgcccaggctgaagtgcaatggcacaatctcggctcactgcaacctccgcctcccgggttcaagtgattcttctgcctcagcctcccgagtagctgggattacagatgtgcaccaccacgcccagctattttttttttgtacttttaatagagatggggtttcaccatgttggccaggctggtctcgaactcctgaccttaagtgatctgcccccatcagcctcccaaagtgctgggattacaggtgtgagccactacgcctggccagcagagatattttcttagcaaaagtggtgaacctagtttctctgagacccttattcctaccgccttggcattgctcactttaggacttctttctgaaaagcccactattccaggtgaaagtatagatttgccgatacctaggctcccaaggatgcctcaaatcctttacttttaattgaaaatcaatagaatgaagaaattcagacaaaaagaggagagacctcaggcacagacctccttggcacagaccaagccagtctctacatccttgtggatgagactggttctgcccaaaacattaagcatgaagttaaaagccagctgcttttagggctgagcagtctagctagttggtatatctaaagccagctgttccagcgagaggccagttgctcacttcctttcctgtacctagacagccactggggcccactggctggtttctgcacacttacagccaacaaaccagggcgcctcttgccagtagagtttcagagttgggttccccaccccactttacagtcttctacatatgccagggagaatactgggccatggcgtctttttaaaaggctcagcttcttctctccttgtcccatttccttttctttctttctttttttttttgagatagtctcactttgtcacctgggctggagtgcagtggcacaaccatggctcgctacaggctcaaactgctgggcttaagtgattcttctgcctcagcctcctgagtagctaggactacaggtacacaccaccactctcagcaattttttgtgtgttttgttttgttggtagagacacagtcttgccatgttgccctggctggtctcgaactcctggactcaagccatcttcccactttggcctccttgtttcctttctaaaactgcttctgtatggtagttcattcaatttttaaatacatcaagctcaaaagaaaatactgtagggccgtgttaacattcatgtaggctggaaacaaatgtagctcagaaccagatttttgaaactgaggatgagaaagattgaaaaggtagatgggagaacaggaaacacatgaagagttatacacgtgtgcgcagagaggtgagaactgagaaggagaatgaattggagagaaaaccttcattagactcagagagggaagcagtggcagtataccaaggtcacttctaatttagaccatctaattggcaaacaggctccaaatggctatcatctcacagggcttggaattaatgaaggctgattattttcattaccttcctcttaagatacaggcaaagtgagagagctggtacccaggtgggtgcaaccgcccccaggccagtggctgccctagagccccagataaccagcctgtcctagagattcacagacacacatgaagcatagagagtcacagacgctgacggaaaaaaatcacaaggttacaaactattggtctcaaaagagataccgagaaaagtgcaggcaacacagggccaggagcatggaagggaaactgtgcaggtacaaaaaatacagaataattaagaactaccaaagggagccaagacaaagggctacagaaggtgttcctaagctgcccaggagccaatcccatctccattatgaggtcatattttgttaaatgatgaaagaacaaagagaatttccccatatcagtgcttcaggatcccagtggtgtgtcctgtcacttagaaagatagtgatcaattagaataatttaagagtattgaaatgcatggtaggtggtctttcctattctcattcaggggacagaaacatgggccccatgccttccacccttctttcctgaaagaatgggaaaataagggcaccgagcagcagctcctacatctctttcaccaatttgaaatctcaagcttctttgtaaataggtgagagttcttatgtgtaactgacattgggggagggctgcccagccagttgtggaggggcccttgtctcatctcccttaagctttatagatttccttctttgatatgacgtgtgcagaggtactctttgcagctctgtttccaataggccaagaagaatgaagtgctgtgggtgtggtctccatagtggagggccagcactgcaattgttcctagtggagaatatttctcaagccccctcatcagtaagaagggggcccatggaagacatagatatgagatgcagagcataagcaagcagctgttaccatagcaacagacatattagacactgcaggttcctgaaagctgtctgataaggtattattaaatgaagcctcctcaaaacgcactccatttacaactgaacagaaagacgttgtgtagaaagtaatctgtttccatttatcagggtggaatttacttttagtgggactgaaccgaactcaagctaaatcctgagactttggacacagacagcaaaaaatatttaccagaatttacagctgtaaataccccggacacaccccatgtctgccaggaatcatctatttgggggattttgcaagcttttcctattctgcagccaatggcaactaactcagtcaacccatttggaaagaaagaagattcactcttgctgccattcatcctagccactcagggacaaagcagacataacttccttctcctggagcatgaatgaccgtagaactggccattccttaatgatatggtttagaaaatggagccctgattagaggggcatttttcatcatgctgttttcactttcctgctctagttggccatgaacaaacatatatcgttagaaagcctaaccaatactttcccggggccaatcttctaataaaatgacagtaaaataccctcccgtggcatgattttaaccataggttcattataatcacttagttgtgaaacaattgcaaattccatttttacaccaaatttttcagaggaaagacactggcatctgctttgattcatcagagcagagatcaagatcatcagtattccagtcctcaaatacgatctcaggttcaccttgtggtaggcccacaaattccctctaaccctggttgctcattttttttttcctgctgaactaaaggcctgagatagaaatgcatagtttggctcaatgcaaactatccccatgactggacaaaccagttcaatactgacagccatgccataactccatgcaaagagaaaactcatccttgcatatacatctttcagtaaaaagtaaaatacttatatgattacatttctcataactttcaactttattcctgaatccattgactttcccttgttgctaacaagttgacttcctattacaagtgcatttcccacaatctgcacacttctcagaaatgtctagaaaacatctccatggtctgctgtggaaagatgaggaacatagaggtttctatacaaggtaccaagcccagcagtgctttagggagcagtgtctcctacataattacattgtcaggggttctagaacagtttgtattgaccagtcccatggacatatccttatgctccctggcattgtacacacaattttatatttgcaaaatacttgacggagggtcagtaacagtggttatcaaacattggtatgcaaagaataatacagtatggctgttgtatagctttcatgagagtctccataaaggttaagaatcactgcttccaaaggtgctagttaatgggtaacttccagaaatctcttagggattggcacccaagcaaacacagaagtaatatcctgcccttgaagactctgttggtaaatgaagattcacaatgaccaccacacttgtcacttgaaatttaccttgctattgctattatgaaaatatgacaaacaatgaatatttgaaatataagttatactctagtccctagggatatataaatgaaatttttactaatgtaaaccagtcatgtagattactataggcccacagtccctagactagatttatattaaaatagcaaaaataatcacctgagtaaaagaaaaatgtaggtcagtattgacaatgcttccctccccacatctctttctgttctttcaggctcccatggttctaggccatcagatgggaagtacaatgaggcctgttacttccaaggatgatgagaaagctgaggaaaccagtaacacagaaacccactggtccacagaaggaggttttcacttacagagaatctttacacactgttcaccagctgatttgaaaatacccacagaaagttaatttaacttcaaagatctctgaaaggcaactcatggctaggtcacctttgagcttcccattggctgctaaagttctcttgatgcatcatcaattatatattcttcatgactaaacatcacttacaacgttattcattaacgtttgcagaaccaaatggaatagaaaatgcctggaggtgatatgtctgtgacctgcacattataacgtgcagttgtgaacagactacctctctgggaatcttcacgtgaaaaggcaatcaaattaacttattactccactgctaaaataatgctaagaaagaggtgagaataattctctttggtggtttttcctctaatgatcaggaaagggcttttttttttttttttgagacggaatcttgctctgtcacccaggctggagtgcagtggcgcatctctgctcactgcaagctctgcctcccgggttcacgccattatcctgcctcagcctcctgcatagctgggactacaggcgcctgccaccacgcccggctaattttttgtattttatttttcagtagagacagggtttcaccgtgttagccaggatggtctcgatctcctgacctcgtgatccacccaccttggcctcccaaagtgctgggattacaggtgtgagacaccgtgcccagccttttttttcttttttcttttgagatggagtcctgctgtgtcacccaggctggagtgcagtagcgcaatgtcagctcactgcaacctctgcctcccgggttcaagtgattctcctgcctcagcctccttagtagctgggattacaggaacccaccaccatgcctggctaatttttgtatttttagtagagacagggtttcgccatgttggccaggctggtcttgaactcctgacctcaggtgttccacctgccttggcctcccaaagtgttgggattacaagtgtgagcccccacgcctggccaggaaatgactttcatagcagcaccaacatagtcaaaagtaggacatcaccatcactggcactattttgaaaagtttttatattacaattagatttacatctttacactaattaggccatgtttatagtggtcacttaggggcatgctttcaaaatctgcagttgtagcaatatcatgttcaaatgcaaaacccacattcacgaatcagcaatatccagctcaccattttcttgctttaaaaatcaaagtatccactgagaaactccctaccctagagttggaaattgcgggttcaaatctcaactctgctccttacaaatggcatcaagtcagttaacatctttgagcctcagtttccttatctgctgatgggaatgtgtcaaaaaaatttttttttctttctttttttaaagagatagagtctccctctgttagccaggctgcagcgcagtggcctaatcatagctcactgcaacctcaaactcctgggctcaagtgatcctcccaattcagcctcccaagtagctaggacaacaggtgcatgcaccactgtgccttgctaattttaaagtatgttttgtagagatggggtctcattatgttacctaggctggtctcaaactcctggcctcaagcaatccccccaccacggcctcccaaagaactgggattagaggtgtgagctagtgtgcctggctcccttttacaacaaaaacagagtttgttatgaggatgaaatgagacataatgaaggtaagagcaatctagttcatgacctgctcagtaaaggtttgaagaatttgaataatgatttcttcatataaatggttagctaatccatgcctctgtcccctgagggcagagaggatgataagggaggttgagaaacacatgttcagcactttgggctatggtcatgccaagtctaaggcagggatagtacaacaaaggtcacagaacaaggactgttttctgacgtttccaactctacactgactttctcgtccaataatacagtatcttgcccatgttactgcatcacctttgaccctggagaaagaccacagggtgctgctcctggctgccttaccgtcataatgagcttctccacgcagtcaggtgccacgctgtggaggtgggtgaggtgcagctggaggtggatcttgttgttgagcatgtcctggcacagggggcagcgaagcatgggttgcaccgagtgctgcgtcatggcatgcacccggagccggttgacatcggcattactgtacttgcagtagggacactggtacatctgtggggaacacacccactgctttgagcaactgtgtgtgccccaagcccgcccacccaaaagtttgttccctaccaatgtctaaaacacctcacctccccaccagcagagtcccttccagcctcacctgctccggtttgatctcctcagctgtttttggtcgcttcgaagagaggggagactctgagctacctgggaaggagatgcgtttggaggttgcaggagaatctgtcagctccttctctgcttggctggacgatgctaaaagagaaagtagaagatgcaatacagcagccagaccaggccagctcccagagggtttgtgttgggtgaaaatcaacattcatttatagcacaggattttcttaaaacaccaaaattcaagaaggatgaacatccggactgatttatcaagcatgttggaaaagaagcaagtgtttctttctcccccatgaatttctgtcactactttaacaactgaacattaggaaaagaaggcaaagaaatggaataaaaggctctggagttggattaagctaaattcagtctgttctaacctcccccaatctagatacaatctgctggcttgtggggggcagtagggctgagggtgggtgggaaagtctcaccaattgctttgccagcctcagtaccagacatgctctgcttcagaaatgtaagaagagatgtgctctcaactttattgtccctcctcttggaatcacaacatggcacagcattggcaacatgaaaaatgtgatttgagaaaggttcacatgagtatcagcacaccaaatatgtgggggaaaaaaatcaagtttgggttcagcagtttgcttttggggaagaaataattgaggagtggaactaggcagggcctgaatccaagatataatctagccagtgctccagacccaagagtttattcagagtgggtgggaatagggaaagtttcctatctgcttgcccaaaccatgcctccatgcccctcttgcttacaccaccaaaaaaaccaaacgctatttaaagaggagtggcccatgaggattgagcagcagacagcacgtacggaagtgctggtgggaggagttctctgaaggatggaaaggaaacatttctttatcttctctatttttaaccccaatcagtaggcattaggttaggctcagggtttatagttaggaaaaacctgctatctgctcctccttccagtagaggcaaacactttgataagaaaacagccaggctaagggtttatccaggataagcaaggctcctccagcttaaacacagtatggttggatctggttgttccataacctggtcaatatctgagtgttggctctttcatttgttttgaatatgggactccatttttcagaattttgtttaaagcaataagaaaaaaaaagtaataaaagtggtagtgagaaaatatatatacccacttccctcatgaaaaaataatgtgactcagcattcaggtcactgaattagaaagcccaatttttattccctgttaaactgctttctgttttaccctgtctagttatctggcatatatttccatttatgcttgggtttgaaatttgttctgatgtggacaccaagatgctgtcattactttaataaacaattttagacaatcaattttattcattaaaatcataaggccacaatataattttgaaaagaaatttgccaaatgcaggaaatatattccaggaagttgatgctcttcccagagtgcacatcttgtgacctttaaccccagtatcttggtaacctggtctacataagtttgtaggacatctattatttaaaaagtacaaggacgagcatattacacacagatcctcctcctcccaacacacacattcataacagtattttaatctgtctcgaatcgacttcaaacccattttgctcttaatgggagttattcattttcacttgaaaggtaatacatgacggctggatgtttaatgtgatggaatggctgccgattaactaggtgctgcaacattctagaccagttcccccatggcctacttcccatctcctggccccgctcagacctgatcctatggaacgtcgcgttgcaggtttgagaccttgcagtgtgatgggccgctcctgaacacatctacatttggagtccttaattaatgtttcaggaacttaagttcccttgcccccagaaacttccttattctccatcattttgatttttgcttagtggttatcttctatatattaactcttcaaatgcattctcaagatggggtgggtgagggcatcaaataatacttccagtgtttatttgtcacagccatttctttaccttctctattgtgaactccaatcagtaggcattaggttaggctcagggtatatatagttaggaaaaagctgctatctgctcctctttccagtagaggcaaactaagacatagattctattccatacacccatccccatccttttgttactctgcctgactaaaaacaacacctgttttacaggactgtgactgccttgtaaatgccctcaatctgcctgccccctactatggaatgagtcaattgtgcacttgctcaatagtgtggatgaatgggcaccgaggctgagaccacccgactcatctcactctcccagagctgaaaagcaaacacagtaacccagtgcagcattagtttcctcataggaccaaagagtccatcctcttccttgaatgctgaacacatgatgaattgtggtgaggttgcagaggtgagaattctggtttcagaagccactattctttccccctgcatggagaggggaacttcttttttttttttttttccaaactcaaactgctctggaattctaaagcttcttttgtgagcttgagctaaggacccattataaagtgttttaaaaaataaaatcaccaattgctcactcatttttctttcttcccagtgatacaacagccctgctttaacatgaaatgctgcatccactggtgcacaaacttcaggttcatctagtttctatctaggacaatctgcacctttattagatcaaatctgtctagaagtggatattagccacctgcagctcactggccccttctctaaagataaagcaatgccatccttataacagattctataaacacccagttacaatctcattgtgtttgcctgagtgatgtggggatggctcctaagagttaactatggctgacacatgcccctcccttgcttgacctcagacattaaaatgtcagtccctatcaagacatcgtaccaaagtcgttacaccatttctgtagatgggcaaacagttgtgcaagttctggcaaggtgcagtggctcacgcctgtaatcctagcactttggaaggctgaggtgggcagatcgcttgagcccaggagttcaagaccagcctaggcaacatggtgaaaccgcatctctacaaaaattacaaaaattagccaggcgtggtggcaagtgcttatagtcctagctactcaggaggctgaggtgggagtatcacctgagcctgggaggttgaggctgcggtgagccatgattgtgccactgcaccccagcctgggtgacagagtgagactgtctcaaaaaaaaaaaaaaaaagagttgtgcaagttctccatcaacatgctatgctggatgagggtttatcacagaccacagtcagaggttctctcaagtttcttctctctgaacagcttcaaaagggccagagtctcagaatcaatttctacttcagttctgtcactagcatacatcgtgggcataagtaaatgaagttgtatgaataccaagagagaaagtactgtggtttctcactttgaaggcttttctaaacttaaactctagaagacatgtcacaatatacaaaacacttttaaaaatcaattactggtcactttaagcctgcgatgatgtcacataagtgaaatggaaatacatgcactccagagacaagacatagtttagacaattggtgtctggaacctttggtttacatcggcaacaaaaaaacaaacaacttgaagcgttagtaactctagtggtttgtacaataatcacaaaatgatttggaaacaatctagatatcttacaatagggcatggtataagtaaacaatggcatggccattctactgagtattagaagacattaaaactgattgctatgaagcaatatggaaaaatcattgagaatgcaaatcagaaaagaagataaaatgtgtattatcccatgttacagctatgtaaaaagtaggtattagaaaaaaagactagaagaaaatgatcattgcctttaggtgatgacatcatggaacactttaagtttttcacatagtcattttatttttaatattacagttatcatttaagttcaactgtccatgaaaaagttggtattggctctatactgtgcaaaacatcagatggtattttttactttgctggtaaaagcaagttctctcattttggcagttataaaatatgaaaatatgtgttaaatctcagtgaatcttccataggcaacatgttgggctcctgggatttcaaaggggataaaaatgtggtaaggaatcatgcgactgaatgcgctatagatgacaaactctataaagctaggtaaatgggatattgtgacaacgaaatgctgggtcaaactcctactcaaacttaacaggacgtgagctatggattccatgccacacagactttccagggagtgagaaagcacttgctctgcttgttagtgttatggtggccctacccaacgcgtgctgatgaggcacaggaaagactagcatgtccctgttatggagttcagaaaattcaaaagtcagctctctgggccaacagccaccacttctcctcattctgtgatgagttggccaactaaaactcacaaagacaaatactgagagaaacaaacctgttcatgattgtctattttatcctcttaggctcctctgcattctaggcaaaagaatttcatttcaaagggaagcacagttgtcaatacatggctcccttagggggaaaatcatttatgcatggagacaccaacttccagatatcctttgattttatcatatttgttttagaagtattaaacctctaaaaataattactttaaaagttacccctctactcatgttagttagagggaatagggaagagagctgataagcattcatgcaaagttttgtttggaatttgcaagaaatggttttattacgttgtaagcatatagaataatgaaaatatggctagcaaaactttgtgtaggaagtgacttactttaaggaacagtatcacttagaaaacttgtcaagtggacaaagatggtagaagcacagcctttcaacattcacagtcccttataacttcatctgataaaaccattcttgctagaacaaattctcatgtgatcccaatctttgctaacaaattcgacatccgaatcactgaaattctggccacagaaaacttaagagttgtgcttgcaatcccagtggacttaatgccaacacaggcttcatttctcatctagtaactctgtacaactctgaagccaagtaaggcgtggagttgctgcttcatcaaagataagcctgaagaaaaactggaaatgaagtaaaacatggaaccttaaggtccctcattttcaagatatccacttgccctccaagaaaaccaacatactggtagaattagtttctgtgtttcctaagcaaaattcatcttctcatcactaaacacaccagtgcgctgttggcatggctgcatcctacgatgcagaccattctccctctggccagaggcctccctcccttggggagatcctgggcaggcattaagctgtccacgttactgggaagtttcttttgcatctcttcatggtggagtgactcctggaggtggtaatcaccgaagtgctgatcctcttcctttttggcgtcctgaggtgagcccactgagggtctgggatgctgcctgacacttgaaccttgtggggaatccaaaggcagccaccacccccacctctcaaccatcagactcttagctaaaaagtaccactgacagcccctccatctaaatttccatctcccaaaccagcaacataatggaggagccaattaaatgattattaattcatgctactttccgtaagccagaggttctcatcgccttacattccgtaaaccagcttgccacctgccccagaaatttacagcaatcttttctctatctccgttgactagcgaaaaaagaaattcacatagctccatacttaatgtctgagttgggataactattccaacacacaagacacagatgtatcaccagatctgaaaatggtccttcagctcataattataattaaatggaaggtgaaatgtgtgtttcccatagctcctctctctcagcttctcatacctcatgctcccactagacagcagaaatgcaatgtttccagagggtcatctgtgcttttggattttgtgatctgactttcattgaaagtagagttactcttggcatttgcttgcaattccttccccagaggacaggctgggctttcttacttgaatctcctgtggagctactgcacttgataagtggccaaagatctagctaaattttcttcctccccccaatagagagaacaacagttcctttaaagaatctgctttcctgccaacttggtctttaaacatgcatggtctcattctgcctccaaccaagcacttagagatgtttccaagaggaataggggaagaggggaaggggatttgtgtgaagcagatgcacgcacatgttcactcagcagggggcggtcttcaggccacagctaaaaagaaactgaggcttctctcttccctaatcaaagaagcagaatctgtctcaacatccagcctggtgaagttaagaaccttctattcaaaacacagtcttattctaaggaaatgcaagctatctcgctcccgtatatccctagaaaacacctacccctaaaagtagaatatgcttacaaaggtatggcaagacacagaggttctatcaacttcacaggccttttgtttctaaaaagggtttcaaagaaaatttgatttatactacacataggtataagagttactcagggaaaggctatttttcttctccaacttaaatatgaacaaaataggtcagcactttaaaaatccagcagctcttagttgttattattacgattttactttttgtttggaaataattatagcttcacaggaagtctcaagaacagcatagagaggacccatgtacacttcacccaggtgttacttattaagcagtttagataaagatttccaggtcttccatcactcttcatcgtgaccctgcctctccggctccctccctccctccctctcccccacccccaatcttgcttacatctaccaagacttagggccctatgcctgtcatacaccttccctgtcctttaggaaagctccatgcctccctaacccagcaagggctcaggacttactgtctagttaagaagtcgatctcaaaacctcacgcttgtcactgagatcgcagccttgaggttcagcaaatgccagaatgtgtcagactcccgggcagggctcattaaaacacagatcacagcccctgccctaaggttctgattcagtaggtctgagtcagataatgtacatttccagtaagttcccaagtaatgctgatggtccagggacgacactttgagaacagtggtcagagccaaggctttgtgtaataggtaggaaccacgctgctttgtggtctaactagaaataaatgagagggcccagcaagcatgggccaatctgtcagtccactttaaatggctctgatgacatgatactctcatctaaactcagggatgacagccaggtttggtctcatagcctagatgttttaaaacaccctcaggccacctgcttactctaaaacaaatgcagacaccttcaaaaccagaaattcagaaggaataagctccatgtgttctgttagcgtaatccagaataaggacagacttccttgtttacagaaatctctttctttccacatgtcctgtcctggagagcctctgtgaaaagagggcaaatacctgtgggctccttccaccttgcagaaagaggaagcgtctttttagtgctggcttccctcggtcaggcacctgcaggcctcagcagctgaaggccctctttgcttcagccctggaagcatgcacagatctatgctagcccccatttgcacaagtcagcaatctgggaatgggggttcaggcaccattctgtggggcctctgctttctctgcaggaagcagcctctctggcaggctctggaagcctcaaggtgggatggtgggcacacgctgaccggtgggtgctgctgcttgctctgcgtattttgggagaaaaatagtgctaagccctacatcagagacatcaatctgttgcactaattccttgctgaagtatgcataaggctgcttaaccacactgatttgagttcccaaaaggccattccacatttcaatttcaagacaccttgctccctctgtgtcaggtttgcaaatgaaccaccagtcaaaacagagccaccacctggtttagaccaacatcagctgttggtctgtttaataaattataggcactggactgccaccgtgagcccggctcatgccaggatttggaggcctgctaaatattcctgattttgattttgacctgattcctgactttgaggtactgagtcaacctgcctgtctttggcctcttgttggttcccccaaaatatgctgtcttcccctggcatagcttactgcagctatggccatggtatcttgtgaggatgggtggccacagtccagggacacactagggggtctgcacttattacgcttccctgtggctttattacaggactgtgaagacaaccagagtgggaaggaacctcagaaacctttggaccaacagaggaaaaagcccagaggtgcaggacatagatcaaaaccagtcgcatgcgagtcattctaggatccggccaaagttaattaacagagggccattcagtctccaccgagtcaaacaataattaggttagttagggtctttgagccccaacacagtctagactctgagacactgcaatataacaatattcttctggtttcttctccattccaaatctatcttcctaaaatactaaattttaagagtgaaagtgaacttgtgaacataaacaggtaaaatgtgggtgtgtgtccagaatggtgacagacagggagaactgctgaatataacttatcagaaccttacaaactggccttccctcatgatccacctagggtttctttttactagtcaggttccacaggaaaatgtgagaacttatacttagggaagaaagacattactcaggtccctgcaaggctggaaaatgggaatgattctccactttcccctccagatttaagcactacaaagactgtcaacatctcttggcattttgtacagtacagagagatagacaccctacattgtgtaatgtttatatttaatatcagtgctgctttccgtctccattgagttcccacattcagctcactcacagcgctccaaaggcctaggataagtgacctgtgtgaagacatggggaggcggttctggagcaccttcaggtactcctcaggaactgatgttttttcacttgttgtttgcctaaggccaagttctctttacccgaaggcatcattcagccccccttgctaggtaataaagcacaatattttgtagcgctggtcacagttggttcacatcctggctgtgtgacctcgagcatcctatctgactacactgagctttctgtttcctcatctgtcaatgggataacactgtctacacatggtttctgtgccgctagccagagatcaggcatatgatgcctaccacagagtctggcacatagtgaaagcgcaaacatttgttgctatggtttcttttttagaaggattgggaaataatactgctggggctataaaaccatagaacgaggggagaaacttgtttatttttttgtttttatgggctttccaatgaagagcggaaagcctgctagacaaattctaaaagctgtaacactgaaacttggtttttaagacaagcaaagacaccttaaatttgtcttttctctataccaggatgaaacaatcctattaacccatggatttaatgtctacaaagcagaaagtagaataacttggacttaaaggtacttatgtcatgctattttaccaattgattgttaacgaaacatctaaacagtattaagcacttgctaggtgctggggattacaaaaatcaatggttgccacatagctcctaaccataaacagctgacaaactctatctgacaacaagagaagcatagaatttaagttctcctcctccaaccttcctaaaagtagagaaagtgataatgttacatgttctttggctttataatgtagaaaatatatctgactcagaaggcaaattgggatttgactgcaactctgacacccgagttcccaatctgtgaggcttagttctcgaggctgcaaaacgaaggtagcattggacccaagaagaatatgagaacctaatgaacgtgctctaatatcccccatggaaaggcacaatggtattttttttaaataatcatgattataataacagaggtactttacaattggcacaaaagttaaagctggaacaaagcaggcaagattaacatggccactctgtaagaataatatgcaaatctataaggtattttctatagtgatgaacaatgatttgctccttaatctacattttcactgccctttatctataccttgatgatagttctcattatactgtgtcataattgtgattacatatgacaacacttctagaaagtgagtttttttttttttttttttttgcatgtcctgtacctgccttagatatgtgtgcaagaaaatatttgttcaactgatgtggtccctatctctcttatgacttacaacataaattctcaaagccaagacctttgaattaactggaatttgggcaagtccagatatacaccacagcctgtatctattttggcttcccaacataaaaatagttcatgatttgttttcaattgtgagacagaattccgcctgcagtgactttaagcagccaagtatactgaaagtggcctggaaaaaaaagagtggggagtgagagaagggggcacaagctgactctggaaaaggtgacacagtcacacaattccaatctacgtgtgaaaacataaaaccaaaaatggtttccattggcaggaccatgaaccacaaaggggccacgcaaaatgggctcccagtattccctcacatgcatcctactgcaaagacaaatttacttttgggtgaggtggagaaatgaaaccaagtaccagaaagatacagagttaggccaaaatgatttttgtagaggtatggtggtggtgttgaatggcctggtttctagtcaacaacagggttgggatatgagtggccactcaaaggcacccatgtgagtctccaaggactcctctgttgatgtcctcatcacactgcctctgacaacacagtgtgtctgtcccaagaacacagaactaggtaagggcatatggtgctcagacattccatcaagaaaagtagccttggtgctgcctgacctccattgagaaagccttgagccttttatccagggtatattaactagccacagacaagagaaatctgggaaagttattagcattccaactttagtaattaatatgctccaagattctataatgctctacaactgtccctaccccagtcataatttatgaagctccagaattgttaataacccatttggtccaacctgccactttacagatttggaaactgaggtccagagacctcaggtcacgcaggtgaacttagtggcggaattaggccttgaacccagggcttctgactcctacgagtcctgtatttttcctaacacgtttcctctcagcacataccttcttttgtccttagagactcaatttggaaaaacgaaaaaaaaagtattttttcagcccctttccattctttgtcacagattatatttcaggcactaagttccccatacaaaggcatctctatttatacaaagctgtaaacaacagggaaaacagggggagggctggtaatagatttgcaccaggatgtgcctgacctgctttttttcaacctcagtaattagaaaggcagcaggtctgtaggaattattcatatgcagcaggagccatacgctatacatttatgttaaacatgtcaaatccgattggaatcatgcctgccagcaccatattccataaacgtacttttccctaacagtcacccagaccttgccagcccattaatacttcctttaatagcaatcttctatagattcaaatcagggacgctccactgcactaattgctgtgttaggtgagcatcatagatttaaaaaaattaataaagtaaaatcccttcaggccaatcctttagaaaaatgaaaacactcaaactaccattctaactcaaaaatttacaaaaatatgaacgtcagggatttttgaagcattattgtggtgtcatttcaagttgagctatttccctgcttcccctccaacccgcatttttcaaaagcaccaataccctctggtcatctcgtcccaaattaccttaactagactcagcctggtactctgtggctggaaaccatgacgactacaggaattaaataaccatcttgctatgattctttgccaagagttcaatttttcccctaattattggtgataaagcatcacattaattgtatatcacttaacttattgcaaataatgattaattggataatcactgcattaatcattgctcagttgctgacacggggggctcttcattcgagaatacacacattcaaatctattctggtaaaagagaacaagggtcattttcatgtttcaaaagagaaaaccacaaagttggacagtggcaatggctgtgcattagggaagagaacaaagaaccttcctgtacccttcactggcccacaggagtacatcacactttccttgacaagatgtgcccgcaagggcctgttcatgtgctaccactcaccctcttggaactctcaggcggttgggactagtggatatcccctgtccatgtttcacagaggaggtacctgagccgaaagaggccaagtgcctcaatcaaggtcatctgctggctggtgggcttcctgactccaaatctagagtctttccacatcaccatcccgctttcagactgagcacaacgccagctccttacaagacatatatccatggttgataatccagttcattttgaacatcctggtggttatcgtgttactatgatcactgtacaatgtcaggagactgctactccttatacttagacatagatgaaaactagatctaatgatcaaactgaaaatgatccttctctgagagatggtatattggtaagagcttgggctctgtcctaagttagaataagtgcaaaagccagtgtgtaaatctgaacctgtctgtataccttttggcgatgtgctagagattcttaccttcctttttttcacatcatggcacacacagaaaatgatggcaaattgggataaacagatgaagcaggacctgtgtacctgtgagcaattcatggcatgcctgctgggaaggacaggtgtgaagctctagaatggtgcctggcacagggttagagctttatgcagccgttataattaccagaaagttgctgtacctatgatgcattctttcagggttagttttgttcctttggggtatctatagctgcacatgtggctacttaaatctaaattcattaaaattaaatacaatttaaagttcaattcctcagtggtaccagccacactttgcaggctcaatagccatatgtggtaaatgactatggtattgttcagttcagatgcagaacatttctatccataccaaaagttccattcgacagcactgatctatagtaatatcggtcttacgactacgggcgttcctgaaatccccagaagaatgttagattccctgaaggcaggccctataatctcactgaatttgtgatcagtggaactctgcccagtgcctcgcatggggtagggactcagccattgatcgtggaattgacccaacctcagttcagatcactatcttgcttgctgtgctgccacccagggtaaaagacctgacatctgaataaaagaatcccaaagaggaacccccaaaaaggaaaccaggaggcccactccaaatgtagaaataaatagctgaaagtgttcagtacagagtacccattcctgcacaaaccccaaaactacaaaatcagtagctgagaaaatgccaattatccaggcccatctgaaatattattaatctgcatcatgaacagccactaatcaacataacagattgtgaaatcactatttatttacttgccaggaggaagcattccccgtcacatgtaatcagataggaacagctcaatttagggagagaatagaacaaacgtagttttaaaaatatatataaaataataaggatccagaagaaagctcagaggaggttgctggcacctgtatcgattccaagatcaaatcggcccaagtaccttaataaagcctgtcattacacactcagatactatagacaaaattatgcttcggatcaaaagaggatcatttgcaggagtcgggaaagaattttcccttctctctttactattgtgcagctggcaaggtgcatctctgagttattcattcaatcactcattcattcattttctctctgtcttttggaagtaaagattaagtaggcctggtgcttgaatgaatgcatgagaaagtggaaccttattaaggacattcattttttatggtgctcattttacgtcttttagtagtctcctgattgcctagcatgtccactagtgctgtgaagacacactcccaatgaatcagaaacactctgagtaagatttaattgaactgctctcaacaaaggctgccctaaactggttggaaggattagagaggcacatatagagtggctagcataaggcagcacatagagtagggactttgcaagtggtggctcctgtttattatttccgtagtgcccttagcacacaaaatgcacgaaacatacgcaccaaacatcattcgcacgatcccattaaatgcttgtatgttgcttctccctcagctcaaaattcccaggagccacatgctgccttgcaacagaggacccaaagagaaactgctaccagttttcctcatcttatatatcactaaaccattaaacaaacaaacaacttacatagagcttacaacatgccaagcactgttcggagcttcccatagtcaaataatcctcgtagcaatcctacagaaataggtactatttttaatcttcatctcatctgaggaaaatgaggcacagaaaggtcaaggtaccttgagtggggtcacacagctaatgagtggcagagccaggattagaaatcaagcacccaaatcgtgacaacaaaggacagatggctcagaaggtcacccagtcttcaaactgtgtttgtgaaatccttttccccagctcacctggcgatctgtttaattgccgtgtgaaccatttgtttagctctcattcaacgttgaggcaaaactgggatcttggtccaggcaaagccccacaggaggatacgtcccccactacattcagggccttcctttgagcacagatgtccatcctccactcctcggtcctaccttacacatcgcctagggtgtttgaccctcattgttttctggagtttaggcttctggacaccacacaggccagtctgaaggggaatgctaagcacagtggacagtagaatccacctggtgtgctgcccattcattcggctgcagtatggccctctctgtgtctcccaggaaacactgaacagtggtacatcacccgccctgcgtatctctcccgatatctgggaactattgtactacctctctaatttctcttttctaggctgaatgacccatttcttcagcctcctctcaaaggcaatatttctcagcccttcagtcattttcattgctctcttctggcctctctccaagattctgtatcttgtttaaatagtgaagtccaacaccgaacatgatttaagaacagtcatgcctggaaaagtaacaaaggcccaacgaatacggactccagaaagtaaacattttctcaaaaacaaaagtattgtaatattaataatggtagtaagaattaggttgaccaaataaaatcatttttgttgcccgtcacatcatttcctcttattattttctagaaggcttaactgtcccctaagtcttctctgaaatgactttgctcctcctcaaaaaccctaagcttttttagtctcagctcttcttcccctcaacatagaaagcttatcatcttgagaaatggccgttctccttctctcaacaccagtttttccagaaatagcacttcctgtcttggcttcttcaatgtcttctgctttgggtaagatgtccccctgcctggctgcactgcttgtctcccctttgggtggatttcagcacatgagtgctcaccctgggggagggggaggacaggaagaatatgcagggcaggcaccacctgtgcagggccctgcccaggcccccaaatgcaggacaaagaccacccttcactgctgactcccttagtaattttttatttttattttatttttattttttggtcacccaggctggagtgttatggcatgatcttagctcactgcagcttcgacctccctggctcaagcattcctcccacctcagtcccccaagcagctggtactaccagcgtgcaccacaatgcctaattttttgtagagacagtgtctcaccacgttgcccaggctggtctcgaactcctgagcttaagcaatctgccgacctcagcctcccaaagtgctgggattacaggcgtgagccattactctcagctgggaatcttttttttttttccccgagatagagtctcactctgtcgcgcaggctggagtgcagtggctggcatgattagggctcactgcagcctcaacctccagttgagggttcaagtggttctcccacctcagccccccgagtaactgggactacaggtgtgtgccaccacacccagcattttttttttttttttgaattttagtagagacagggactcgctatgttgcccaggcaggtcttgaattcctgggctcaagtgatcctcccacctcagcctcccaaagtattgagattacatgagccactgtgcctgacccttagagaatcttgaggctaagaatcaggggtgaccctgatcaagttccacatgacaaatctctccactggccttgggagcaggtgggaccagcgactggaccttcaatagaggaagaatgacatcaagggcattttggtgaagagccaccaaagagatgtgaccaacacccagatgcccttgcacacagcttggcacttacctggatactcaataagcaagctggctttggtgccacttaaaaagcttaaccattaaaaactacagtataatgtagtataataaagaagaataaaggtgactgctcaaagaagcaaacgaaatctccctcccactcatcctttttctgggcagactaaggatgtatccgctccctgacttgttagctccattcttccagggaaggaaagatgagaaggctcaaggacagccacacacactacctgtccacttgccctggtctttctcacctccgccctcttggtccttagcaagctcctctggatcagcagctgtttcactgggtccttcaacatcttcaatggcttcttctgaaacagaagaaaaacatgtcaagggttaaaaataaaaagaagatgaaggacttttggcctctgttgcaaacaactgccaacgacagaacagacaccaatgactcgtcccccttctctttccagaggcccctgggagactgacggtgctaaggatatactgaggtctgggtaagcagtggggactttccttctgggtaaacagttggtatgaggttgtgactcgctccagatgtgtggccattaggtatttccagatagattctgaatgcttcgcttgagtagttctaactgaaaaaccaatcctggttgaagcagtaactccacctgaatccctgaagttgcatgcaagtcttttacacttgaaaatgcaaaacatggccacctgttcacttcatgcctagctccattcccaaagcctcctggtactggcctagaccagccccagtcactgacccctcacagggctcacagtgcctatgcatgtgccagagtgtgtgggaattgttggaagtcatgcaggttgcgaagagtcacagaatatcagtgatatgagttcatcagtttgaagagttccagaaaccaaatggtatcttgtgaacatgccaggaggcagtggtgggaagtgagatttgtagagtaagggataaaaatttgtaacagagtcgtacactttctttttgaagcaattccatccttcactcactacgggtttaaaactaatgcaggaaacctctctccagttcagtacacagtgctacagtgaaggcagaatgacggctgccaacgctaggctgcttatgaagtcaaatgtcgttcagccaagtggggaagaagagaataagatactctagatgctgagggaaagaaggggagacacttctctcttgctttcctggccctccgaaacattatccaaaacatgcattcagtaagagtgggctaagggaatgaataaagtggacaaaccaaggtgaaataattttaataaagatgaaattattaggaggctgtgaagagcacattttctcaggtacacaggcgtgagggcaaggatgcccacatctgtcagcagaccagaccccagcaaggaagtactgggtctggcttagaacactggatcaggcctctatccagcaccgccagaggtctgtccaaccccaattcaacttttcagtattttaaagtatcatgccttctgaccctctagaaaacagcctctaccccaatgctacttttccatttttctaaatgtcatgccttctgactgtctagaaaacagcctctaaatgtatctcacgaaggaagtaacaggagtacaaagtaaattggtctcaaagggtttctaaaacactgaggaagaagatgtctatttagaatcagattgtcttgactcaagagatgatggaggtccaaggtctggaaaactgaactagtgtcacggaacgttctttcttccttaccaccaagagggagtttatgaggcagtcactgggaatacaggtgaaatacggtactgtttattttcatctccaactcaggattccacatataatttctctgtctccttctttgtctcactgcacaataaagtcaacatcaagtttccctaccctacccttagttcaaacagagaaaaatcaggcaaccacagcttgaagtcaatcagatatagagccccacattgacaccatacatcatttagtagagtaaacatgtataggtgtcagtagagtaataacaaattacacagcgtgacacaggaactatcttcattatgtccaggtgggacgttctgtgcacatttttaggatttcaataaaattgttcaacactataatgataaaattcatctttgaatggtgataccagcgtgcggtcaatgaatattattgcattcggtctacccagatgagctaggtcccttaaaggacccttatttgtcccaatacatgctgtgatacaaaatatctgtagtgttgatacatttatgcctattgttccattattggaacactaagcttgtaggagttatttatatcctactgcccaaggtcatcgccaaggtctgatttttcacacacaaaaaatttgcaatctccagcataaatgggataatcaaatttgattaggcaaagagatggctcaatggcctctcatctctagtgcatacatatgaccaccttagatgaagacagtctgatacctacaaactacagaacaccctgagatggtgatgtgcagtgtctgaaggtgctgctcagcagacatgggaagggatttacccactggggggccatctccaagccagcacattatacagcctgcagctatcacagcagagcactaaaaactcacagtcacccaacactgaccccaattctttgagccttaccaaacaaatctgttgagaaactagagactgtaatgtataagcagatcattgatgcatcaagcatggaaactgcatgttgctttgtgaatattcctggagctctcattctgtgagcccacttgggcttttgctttcttccctccctgccctactgcaagcagaaaatgaaggcagctgagttccgatgagaggatcaacgaaagaggttatttcaagaacttattttgcttatctctttttttaaaaagatttacaaatcaagtcctcttcttgagttcctaggtttaatattatcatttgtgattcattcactaaaaggctgttctatgcgtggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgcctaacctgagcatgtggaaataatatatgtcttcaagtgaactgtctggtcctggagaaataaaataggacattcataagcagttacaccatctgtctttataccatcatcatcaacagcaagaggaaaaatagctctttaaaatggatgaaagcccaggctgacagtaaccggaaaactgtgagctctgaataccaataaaggtagagaaatgattaaaaaacagagatgcaaactgaaaatttgtctggacagctcaggcccacgatgctttgcaggcagggtgtgttttattggttccgaaagcataaagcaagctgcttaccaagagccaggcctggggaagggcttggtctcccggccctggaaacacgtgggaaccaggggcaaaatagcatcccgctttgaaacagagatctgcgtccacacgctaagctcctagggctgttatctagcccttgttctctttaggaatgtagatttgatacacacgtgctggagaatggaggggaggttttttgcttttccccccacagatcatggattgcattcccccctcttctgcgaagtcactggtaactggctgggtcattattacagaggctgcagatttttttcccctataatattagctactgacagatggtgggaacaagtgaagacctgatggactgatgatcggttttatctggaaaatcctgtctttcctacagaaaaagagaccaagacacataacagccactgtgccatttttaaggctgaaacagacaaatcaaaaccatcttctccttcaagcatttaatggtatttccaatcccaaccagagcacaccaggaatgctttcccaagggcgtggccaggacctgggagagaaggtcatccccactcccctagtcccgccctggttctgggcaggaggtagcaggcccaatgcctcccagacagctctgtgttttagaagacaccagagaaggtgtctctaaaacccatacggaagcccacagtagcctcaaactggagcaccccctcctgtgtgtgttttcatgttaaagagttagggaaataaaagcaaatactggaaaactgcagtgtcttcctagggtcccttctgcctttcatttccatgttcaacagtgactgaaggcctttaaaaaacctctttggctgggcatggtggctcatgtctgtaaatcccagcactttgagaggccgaggtaggtggattgcttgaactcaggagtttgagaccaacctgggcaagagagtgagactccatctctacaaaaaatgcaaaaattagctgggtgtgatggcacatgcttgtagtcgtagctaacttgggaggctgaggtgggaggattacttgagcccaggcagttgaggctgcagtgagccatgactgcatcactgcactctagcctgggcaacagagtgagaccctgtctcaaaaacaaaacaaaacaaaactctttccatcaccacctcctttttacaactgcttctcccagatagcacttacttactagtgcctggcaaaatccagcctgctcatcactcaggcttcctgactaagtgcagagccctgaagtgcaagaattccagcagataaataccttctaaaggggaaagcttcctaggacagcttcagttaaggggatgataccccagtcccagaaaatttcccttcaatcaaagtggttttgctgaccacaaatgcaaattgatctcttaatataccttatacttagcatcttggtaaaggtgactgcacaattcccccatcggtggtgaaatctgctcctgaaggaggagagcatgccaactggcagccccatgggaatttgcaccaatcttatgaacaacctggaaattggttcgcgaaagcagcaccaggcagaagccaaaaatagaggtggcatcaccacaaagccagcattcaaccccgcaacctcactgtatgcactccccaaacgcatcacccaagaaaatgttctagctgtttaaaaaagaaaaaaaaaaaggtactattttcccaaataatgggggccaagtgacgtgtccacggcgggtattctacgaatcacttataagcttgaaggaaggggagtcaatcaatgattaagactagtccctctgttcctaactcttaacaggataatgcagattaattcaaaccttccccaaacctgacaaagcccccatagtgcctcagtgtgacagaaatttggaaattctcctaagaatcagggtatctgtacccgaggctctcacatgatcatgttacttaaataatacaccaatctgtgatccccgaagaatgaaattgttctttcctttttctttggagggtgggatgtttgagggtgggggtgaaataaagtgcgtttgcctgtcggcaggctcaagagctgagaaacattagctgtcatgaaccacaatcaaatcaggtttgaaatatttagcagtggcttggaaaatgcggcggtgcagctctgacaggcgagatgtgcacagacacccactttccattataatggaaatatcaggcctgttctgaatatgtataacccagaaaaatgtattgatttttcattcggcattaaaaaaaatgaaatagcctgcagctgtcaaaagccttttgttaaaagctcatctttcctggaatgaggtttaccagaaacaagttttaattgtatataggacctcttctttgaaaaacaaaataacctatctgcttactttgaagatagagttaaagcttttcctttctccattttcaacctaattaacccaaggacgaccactgaagcaggtgggaaaggcggggtacactctgaccatcaagactgacacggaggatggcagctacaagtggcgtttgctggtgtctctgtggtgggtggaaggaaggactcggggatgtgcctcgctctcgttcctctaactcctgtgtaggtgcggcatcctgagactcattgtataccctgaccaatcacttgtcttctttaagccttggctggcacaactggaaaacgagggcagaacactctagcgtgtccaatcctcttggcattttgttatcaatgggaaacctctactggctgcaaatattctacagaatatgcaggctttattttgcaaatacaggtcaaatcaaatcccacaatataaaagatgactactaaggcctagaccacttatttcaaataaaatccagtgcgttataattctgctacaatagaaacttttaacggaacacaatctgcaatgctggtggacgggcagttgtgttgctcccagcttgttacttctactcccgtcttctctctctaagccaggaaggaagaggctagtggtggtaatctttgtggctacaccgatggaggtgggccactccctatgccattctccctctgtgactttcgagcaagtggagtctcatcgaatagtgaccacaagtcctgccagtgactctccatgagccccaagctatatcctacctgtaccgtgacagccagacccagaatgtagcaacctactctgcaacatcccagacacatctcaaatatttactccctggttttattccatggtgttcttccagccctgacaacctggctagatgcccgagaggtaacttccaagcgattaggtcttctgggtaacaatgccctgcctcgggaattttcccttaaatcaaggtggtttttgcttaccacaaatacaaattgttctcatcacacatcgtacactcagcatcttagtaaaggtgactgcatgttctcatgtatgtacacggaaaagggaatttgccaatctccatggaagtcctctgtggataatcatctaaattaaaaaaaaaacaccaaccaactttgcccattccatcttctacttctcagcagagtatatacatttactgaggaaaacgccagatcacaagaggaagggcctgggatccaaaccagcactgatgagtgggacatattgagctaactaaccctatggtagtccaggcaggaaacctcgaaggggtgaagactgagtgcagatgtgtgtgggagggtgggggcaggagaaagcaggcaggggctctacagctggagcatctatttactcatcagaagtgtaatattttcccaccttctcaggatgtcatttcttttccaatgggcaaactccagcgcatgaataaagctcgagacattcatgcccatttgctctctgcgtgtatgataagcaaatgggcctcccgcactcctgcgggcctctagaagctgcctcttcagtaggaccgaagtgcaccaagtcaatgggacagagtgtgggaaaaacagaggcaggtctccctccaggggcgccattgccttcatccttttccattttctcacccacttaatctctctgccatgtgaaagacctctctccacctgctggactaaacagtcagaggtcagcctaatgctcctacaggtaattttcccaccctggtggcttaccaaaacaaagtggccaaactgctaacaaactgctagcttgttttaaacaaaactgccttctcaaagatgacaacgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactacaggcacatgccaccacgcctagataatttttgtatttttagtagggatggggtctcactatgttgcccaggctggtcttgaactcctggcctcaagtgatcctccttccttgacctcctgagtagcagaactacaggtgcactccaccatccccaaataattaaaaaaaaaaattctagagataggggtctcgctgtgttgcccaggctggtctcaaactccccagctcaagtgatcctcttgccttggcctctcaaagtgttgggattacagatgtgatccactatgcctggacctacaaactctttttcacatggatcctttaagtaatcattttaccacaagaattctttttaccactagatggtcatttaccaaatacacctggggccacagcgcctggagtttctggacagcttgaaaggtggtggagagctgccagcttccaagggggttgcagcagggaggccctgcaggaaaaccccacactgaaggaattcagcctccttaccgcccccaccctgaccccgttcctgtcccccattaccaccatccctgttttttggcatcaggctctaagaatcaacactctgaaagcaactctgggtattattaaaaatgactaattggagaatagagaccatttatgcttttgtatatttgaagatcttaccactgtttacagaaacaagaaaaatggggattgtgtggcaagaggcagcctgggaagggagggccaggctgcagctgcgtgttcggcccctgctgggcagagtatggcccagctcaacaagaatgcaagcctgggggagcctctccatttgcctttttactttacctcacctccaacttgagcattgacaggagagagcctgttacgagtccaaagtggccagggcctattaaggcctccccgagaaaatttcccctttcagccgtccctcctgtgggaacagcacagaacgccagagcatgaagtgaaaaatgctgccgttgtgtggtgagggacgggtcctgccatttttcctctcccaggcaaggccacttggccatttgaacaatttgtcaaaaccgcacaagaattacgggggtgggtgggggtcaagagaggagaaaaagggaggaaacgcctagagccagtattgcaacaagttccatttatctgtgttcttagcaaaagcacctgggttgccccctgcagaaatccagaaaggataaaagtaaatgtgcggtgacaaagcacaacggaacgaaatatgtcgcggactcgcctggtggctattcacaggaagattttttttttttttaataactgaaaggtgtgagttccagtttgtaaaatacaaacccaaccctgaaacgctctcggaatacacgctaagtaagaaagctagctatgtcccagaactctgaagtaaacggaattcagcagggattagttcccttggatttctacagagccatgattgttgctgttactttcacacatgaaatgtaaaaaaggcaaattccccgagcatgtctgtagcagagcgtgatgtgattgtgttgtcatttatgggaaataatcgcaggcccatctctcccttcccccccccattttccagtccaaataaccatgaaaaattacacttcaatgtcagcgcgacgacaaaggaggcgcgctctctgggagctcagcggatttgcaggggtttttcctttctttggacaaaaactaccttcaattgtacttcatttaaaacgtgatctaacaaatgcattttgacaagttcctttctctttttctcctttctttcaaacagtattttacacagtttaacctcacaccaaactggaatgttctagaaagaaggggcatgcaaaatagaaggtccttgataccaagaagggtgtcccccatctcgttaaaaacaaaggagtcaagaaaaatgattccaacccagtatgctactgagaaagagaggaggatgagagagaggaaacagtaatgtcttaaagacagaaaatttgataaagccccaccccccccaaaaaaaagctggagttgatagaagaaggtctcgatggagtatttatttgctcatcagaattaaccattttgtggattcagaggcatcatctagggtgtctagatttatggtcagaattgggggttcatgacaatgtgggggggatgaagaaggggagcttccctgatggggtacccgttccctcctgtccccttcctctgtaggaagggacatttttcaacagagcagacctgcctgaaagctttttaacattccaggtgtgaggctgagcagtccctacaagcatctgtctttcaataacaacctgccggaaataaacactgccaggtttccatgctgggaggggagaagacaagacagataaacacacatgagtgatagagagtaaattaaaaaatttaacagtttccattaaagaagactggtatctccttctgaatcaaaactgacttggcttgtcagagagagatcttatgcttaatgcaaaaaaaaaaaatccgtttccttatttatttatttttaattggaaaatactggaaatatatggatgaaaaaaagtcaaggagggcctgtaagtgtacttaagcatctatatacaaatgaaggtgtatgggaaatgaacaggatgtaccagaactgatattaaatgatggtgattagaacctaatgggcataagtgaaaccttgtgggatggctctcgtaacaggagcgtcaacggtgatggatgcaatctatacaagaacgacagccagggaaggagagatggaggggcggccatgcaggcccaaggcatttgcaatgctggggagacacagtttgacaataccaatgggaatgacggactatttggggcaaagagaagcaaaaaagcaaagagaaaaagaaagaggtaaacattttgtgtctgaccatcgaaacaaatggcacacaacagagaaaaataaaaccatgactccagaggtctgagtcacatgaggatacaaatgagggacttggattccctgtttgccaccttactctgaagcccacagcgtctgaagaatctctaacctattcagaaaacagcttcacccttgcgaagcacagaactcaggcagaaatatgagtttactcccaccagtggacagcagaatgaggaactgactgtcaatgagctttgttttgcatgatcataagccactaatatgcacagctggtaaaataagctgattcataaaaacaaagcacaaacaaaaggcttacactttccaaaccaaatctggggaacagaaatcaggccagcttgaggcaatgctgcacccagaaaaacaccagctaaatctgctctcccttggccagacccaagcatatacaaaggtcactacgtatttacaggttgcacattcaagaatgcaatgctagaaacgtgtgaacacccggagtggccaagaaaagacccttacaactgcaagcatcgtggggagccttcaggtgcctaccacgagttccctggtgccagcggagaagagcctaactctgccagaagccagacccaagacatttcaaggtgcgtctacacgtggaaagtcaaaaactgggctactctccaaaaaccatccagtccccaagcatgcatcagtttgaaacaaacaggcaacagaagcaacatgtttcagttgacatttcctgggaaactgcaaagaaagtgaagcaggaagctgaggtacagagaaaatccaaaggtttacgttcaagagctttcctccattaatgggggaaaaagcagatggaattgctaacttgtcatttttaataggcaccttgtacagctattctgtgtccaaggggagaaagaatattggatcctcctcctctttagaaacttagaaagtgatgccagtagttggatccaaagcctctgtttttttaaagtttggatcctgtacaatgaaacggtcttttgctagggtttaacaaaatgccacccccacatccctttcacaatgattttagctacagcagcgctcctcaaatctcccacagctactaaactgccctgtagactcagcctcaggactcgctgtgtatctatttagcttttcctcctgtgaggtgtttctcagacctaagaacaggctagcaacccttgaaaagcaatacattccattccacaaatgtatacagcaatatctctcaaggcccaaaaacacacagtgatagtcatcaagacaaacacttgaacaaaagtaatttaaattctagactcacaccccatcctgtttagtggtgggaatattcgaaaacaacaaatacatgaaacctaagagaaagaaaatgttgccatgagatgacaaagtcatcagggatcgggcagaaggtgcagtttagtgacaaagagttggtacttgacacagaaataagggatctatagaaatttgtagcacacaattacattttaaagaaataatctgggatgctgagatccttccgtgtacacactgcagttggcggaagcactagaaacccgctgacagaaaaatccttacttcagacgtccccaaactttcataagtgagcaacttgtttttttgttttttttttcttttttctttttttgagacaaggtcttgccctgttgcccaggctggagtgcagtggcaccatctcagctcactgcagccttagcctcctcggctcaggcaatcttcccgcctcagcctcccaaagtgttgggattagaagtgtgagccaccatgcccagccagcaacatttcacaaagtgaaatacagaaactggacagtgagagaataaggaaaggaaactcgaaacaaatgaaaggttatgcttcactttgtaaggccaagattttagcaaagaagggtaaaacaagccagaggtgtgaagatgaactaatcaaagggcagtgcaacactgaagataagaccgtcccatgattagaaagaataaagtaagtgattcttcacttaccaagcaaaatcttcaaataggaggaggtcggaggaaggagatttagatggcaaccaatgaaaactttcaaaaaacaaacccaggtaaggttatatcttaaaattaaatatatattatggtaggaaaaaaaccggatcaatttctgttaagaagagctagcctatgagttgactcaactactaaagaactttgctgaaaggttaaaaagaataggaaatgttccaggagaatggaaattaagacagaaaacagccttgaagacaggtaacttgaagaatggagatatataagcaagaaaagataaaagggacattggattaaaaatctacctgtgtaaaatttagctggatacaattaggatggcaaaagcagaaatttcttaggtgttttagaaaatataaaaaggataactaggcagaatagtccaaacacaaagagagcataaacatgaggacagcagatctgggaaggaggaatgaaggctgttcgcaaaagcctggtcaccggcaggttctacctgtgttttgaggtatttgggggagctgaccacaagtacctcaattttacagactaggagaccagggattggagcaggatagggctccaaagccacacagtggggccaggcacagtggctcacacctgtaatctcagcactttgggaggccaaggcaggcagatcatgaggtcaggagatcgagaccatcctggctaacacggtgaaaccccgtctctactaaaaaatacaaaaaattagccgggcgtggtggcgggcgcctgtagtcccagctacttgggaggctgaggcaggagaatggcgtgaacccgggagacggagcttgcagtgagccgagatcccgccactgcactccatccagcctgggcgacagagcgagactccgtctaaaaaaaaaaaaaaaaaaaaaaaaaagccacacagtgaggaaacctgaaggagggtgtctaaaggaggatgaaggccatcagctgtgtagggaagaagtgctcggggtgacgcttacacagtcaaacaagacagaagccatgggcagtgtgggcggtgcagcctcacaccctgctccctgggtgctggctctgcgggaatcttccctccatcaaggtggtgatgttgaggcaggtggattctaataatggtaccatagttgttcaaagcaatgcctaatttttctttacagtttaagacaaatggcatggcaaggataaaaaatgaactcaccaaaaccaaagcaaaccccacgatacacaaaacaaaaccagccaatcctgtttccaggcacctggtaccctgttaacttcctgcccagtggcaacatgaagccccaaataaaagcatcacatttaaagaaaggacaagacacagctctctctccccctctcctacatccgcacacactcacccactcactcacatactcctcccctccatgctcttttctggaaaggggggaatcccagaagtactgctcccaaatggcttggggcagagctcatcatcgatattctggatcagggtgaggtccaaggcactgctgacagggttgctgtcacagccccgaatcccagccacagagaactagcaaaagccaagtaattgctttttccccttccactaataagcttttcagcagaggaagaattcagcttcctgtagtcaacagacccttttttccctgcctctcctcgctccaaataatctaaagtgactgcaatttcagtcctggctctccagcattcagctccaatggctgaggtcagagggtgtcaagtgagggctctccatttcttttctactctgccttcacaccgcccatgtttctttgtaactgaggcaacctgcctccctcgcccaaccatcacatgcacccccagcacacagcacacagacctcacattccaggaaatgtattttaaggcccaaaacacactggggctcaggagtggtggtgggggggtgggtgtccctttgctgtaaacaactaataatgactgacctcagatgctctggtgaccagagcagctgatatccccgttcttagaaaatgcaccgcagcaggacattggcttagaggtcgttaaaccatgtggctggttgtgcggtttttggtttagttttatgcaaatgactctggttcctaaattcttaagatcttgctatgcatttgtggcattggtatcttcaggcctggctctgtgtcgaatgagaggcaagtagactgccccgaaaaccctgccccgccccctccccttcctcatttccgagatgaatgaaatgctatttcaattaagtcctgtagtaacagtgctccccttccctgccttcatagagagctaagccgagagcacagacagaactgaaggtgaacaaacaaagggaaatggaatgaatgagagaatgaacaggtgcatgaggggaacgagggaggccccggcaggttcctgctcctccgtgtggcggaaaagagggcaaggtgcggacaccagaggcttgcttctggaaaagcagctccaagcgggggaaacagaggcagcactgcggagatgaggcacacttcttcctccccctgcgcccagtgcttgtgaaggtctggaagggaaggaaagaaggggagatgcacctgagaaaacactggaaccccctccccctgccaccacacacacgcctagaggacgcacactcctggctgcagcccggcctgtgatgggaatttatttccctcaattatgtgctcttgtccccagtctcagttcatcagcacagtgcagccaagtcaatgaaaggctccataatgaagtcatcgcatgcacagggacatcccggcacctgcccgctgggctggcagggctgcagccacgcccggccctgaaccaggcctgcgtgggctctccgcccccaactcacatcactgccccacgccacgtgctcccacgctctgtgtcacggcacccccgtcctgccccaggagcctgtgttctggctgccatcttctttgccccaatcccaaatgttctgaccgcaaagcatctgtgacccagaccaatcagtacaaaacactgacgactttccctttctcctgcctgtgtagaccccttcaccaccaagagcctgatcacaaaaaccaataccacgcgcctggaaagcctccattggcttaagtcattagcaagtatctaacaatagcaacacaatcatcactcagctgaagtagatagtattaggactctcatttcacagatgaggctcagagaggttaaattactggtgaaggtcacatagctaggaggtgacagctgatgccaaggaccatatgcttaatggctacctctagaggcaccaaccatggtggccttcacaggagaacacacacttgtgcttgtgctgtctgtccatccatccgcccacccatcacatatccatgtggcacctaccccaggcattgacaacacggctgtgaacacaacaggaaagcccctgctctcatggggcaggggcaggaaggagtggggagagtaaaacacagtaagcagctcagtaagtgagcatattctaagtcagaggctgctaagggtcaacgataaagtagaaaaaggaatccagggagttccttaacatgggaagctcagagagggtggcatttgcacacagacctggaagaagtgagagtgtgagccacaggaggctcacatggcagaggcatggcacgtgcaaagacccagggcacagaaggagggctggcctgctggaagagcgctgagcgctaagcagggagagaagggacaaggcaggggataagctcagagaggtcttgggcagcatcctgtaggccttgctacccactgcaggccacgggcactgtgagcatgaaaggtacctttgagaaagtcagaacaaggtgctcctccagcacctcttcctctgggcacatatggtcctgagacccaccactccctctgctgggtaaggtagtgtctgggatggactgcagtctttatgcatcccccttagcagagaactgtttgtgtgggggacaacctgcacggctttagctggtggccccggcagggatttccagtagaaaaactcctgtctttccctaaacatgcatgtgcaatatatcagtgcagatacggatgtggctgcagatacagataaaatctctttgaacctttccatttactgggggctggcaggggtgggggtagagctggcctcacggtgaagaaacacaaagaggggaagcggaccagtggctatcctttgccatgggcggtgctgcagcacttggacagtctggacgcccataaaccaaaggacccatctgaccatcgtgctctgaagcctctccctgagaagaggacagggcagcaccaagactggggtgaaggactcaaggctcagaatggcaaatgcagaaattagttactgcggtgcaaatgcagaaattagttactgactgttctgcatgtcccttctatggaaatgcattgtccctgcacctaaatgtatttcagtggactttgtaaatttaaaagccatagaaaactatgtgacctcggcagggctattttaagctagcacttcctagtacaaaatgaatttggtattgaggatgaaggggggactttatttttctcaaattggctgttgtagaagaaagtctgctcaactcagcactacctaagacgtgtctccccctagtgacacgcagacctctctgctactggtgccaccaccctgcagtctcagggctggagcaaggcagctaggtgcaggcaggcagcattagttctgcaggctgcatctggccctgaacctaggaccagccatctcttggtaccctgggagctccaagaaactcagtggtcaggccccggagtgttccaggttttgctgcaatgttaagaagtgagcccggagcacccccagggcagctgatccacacacagcttccgcagccaagggaaaagaggggatggatggaggccaggataaagaaggggaggggtggcaggtaaagggaatctccccagaggagtgaattcctttccaggcttgctggggacccaacagggacaccccaaaaggcaaggcctaaagccagagcaaaaacaagcagacgcaaagcaggggagagtaagcgatgggcgaagacataaaagcccaaagatgagagctgaatggaacaggaagcaaaccagggccaaacccatcacggcttaaagcaaacgttaatgtaggttccacattgatctgaagcccgagggggaggaggctgggtgcagccaggctcctcccctcctccatctcattccattcacatcatcaggagaactgtgttttggggaaggggtcaggacaatgattggagcctgaacttagctgctgccttttacagtagcttcccagaataaactgccccaagacttcatccatcaccaaaaaaggcaactgtaaaaacacaggtcgccagccccttgcctcacaccagcacagtggccctccctccgctcctggggatgggggtgctgagggggaatggagggcaggcgctcaggcctggcactaattgctcttggggatgctgtgtggtgtgggggctgttccctgcgctaagcagttaggaacttcctaaatcattaacctttctcggagcgcattgtactgggaggtgctccctctgcagcctattcacgagccctattgatctgccgcacactcggtgccttcaaagttgtttatgatcaatatgcaaattgcccatggcattgatctagtattaattttcaattagggaatccacaaggggtctctgagggtcaatacctaacaatgcaaaggaaactccgctgtggagtatcaggcctgatgctgataaaagcttcctaagcctcctcctcaacagttccaggccctctgggctgtcaccttcactgtggctcatttggttccctcctaagtcagaccccttcggcggcctcccaggctgggtctgcggccatcaccctgtgccccccctcccaccccctatgccactggaacacctcctggcctgccagtgcctgcccctcttgcccgccctcctgatcagatgcccccagacatgcctcctcatctccccatgccacgcccagacccaggaccactctctcccccagctccccaaccacacataccttcttcctccctctttccctttccctcgtttctgcttagtcacggaacgtcaccttggcatgctgccacggctggagctggcgagctgcacggtccccagaaatctcaggcaggcaggcagagcgccgggctgccaggttatgcttggcaaacaacccactgatgtcatttcaaaaaaccaggggggaaggaaaaaggcacagcttcaaatcatctgtttctccttctttctttcgtctagcaaaatttttcttcctaatgaagcccgggggtgggggatgttaattactttaccactcactcatggttcccagaagaggccaacgcccgccctccaggagcacagggcagtgcgtgtgagccactgacggagagtgtccctggggacagtgtgcccagctgggactggaatgacccgggaactcagtcattccatttacgcccctaacagcccctgagagacttgcgtgggaaagctctgcagccagaggagctgcaagagaaaaacgtggcttggtctcctcccagcaggtagggggacaaaagcagggctcagccatactccagcctggggcccagccggctcagcctgacttctctctctgccaggaggttgaaatgtgcttacgtttggaataaacctgcctgaagatgaggccacgatcctgccaagatggtgcccacgatcctgcctaagtcccaacccatgccctgcccactttccacactgccactcatggcactaaccagtgcattagctagccaggctaataggtttatggataacattaattaccacgttcctcattaatggatgaaatctttattggtgccattgatcagcggacttgttagctggcctcctaaccaatggcggatgtaacaagcgttcttattggcatatcaattaatgcaatcaattcctggccaacggctgccattcacttccctggttgttcgagagtaggagacagagccctgtcaagagtgcctttacttagagctccagctctcagctgacttccaggtgggctctctgccacttggagttcacctaccaaaaaaaaaaaaaaaaaaaaaaaaaaaaaaaaaaaaaaaaaaaaaaattcacacctacccttccatctgaaaatcacctttccgtgttccagtgatgacaaaagtgctaagctacgtcaggggacataagctgaaagaaaaggtgggaacggtcgggggactgtcagagcaaacaagaggattagagaaatcagatgtttctaggttaggcactgatagaaatgattcaggccccagactggactagggacaacactccagatgggaccagcctgaaaacacaagccacagccatcatcagccctctgcccaccctggggaagccttcctgaccccagcctccccaagccacagtcacacctactgtcacacctacaaagtcacacccaccagtgtctacctcacttagcacttcagaccacaggtcccacatggaaacatcacctgcccatcttcactcctacgcttcagtacggaaaaggacttaccacaggacgaacgaccatcccactgtcactaccaagtgtgcagtaaatctgtgcacacaagtgctattttcatgtgtgttgaaatacacatagtcaatcatttcaacagcacttatatcactgtagagtcgaagttggggaaaaaatttctctgggcagcgagaagtttttagggacattgattagaggaggctcaaggaactggggatatagggtgggtccacagaaccatggaccatggtagagctggactactgatgaccagtgatcaccagggcattaacaccagagcaaagaggccgggctcgccaggcccacagctttgggaggaaacgtggaggatgcctccccctaagatgtgctttgggctcaaaggattgactggagtttgccccagatgggagcagcttgaaatattattccagatttgtttctaaaagcctaaaattaaaaaaaataataaatcaaaaaaggaagaaaaatcactactcaatgatgctagagctattaataaactctgcaagcaggaacatttgactcaaggggagggggtgcaagcaacgaaaactggtgggaagcagatggggttggggggagaaagtagctttgggccaagtggtgacagggcccaggagcctgactgaggctgcggtgcagggacataattctcagcgtctgaaagcatggctcggggtttctaggataaacagcagaaatatttcctttcacttataaatagaaagtgccatttttttccacatggaacgtcatcacttccatgttcacagtacggaggagaggagagtcctgagcagacagggcagggaccagagagagatgccccagccagatgttacactctcagggtggggaccaacagataccaggaagaagagggacaagaggcctccaaggggaggccaagacctctgcaatccacgaagtgactttacatgaaacaggattgcacattctatgcaaaggtcacccaatgtgggtgacagggagataccccgacaaggggctcttcatcagccactcaacaccacggcgagtcttccagagagagtactcttgggttcttgcaacggcaaaagtcccagtgtacttctgactagagttcctacagtattaatataatggtgtctaaattcctctctggggagctcccaaataccacaagggttctgcacattttgattccaatttcacttttttttttttaagatggagtctcactctgtcgcccaggctggactgcagtggtgcaagctctgctcactgcaacctccgcctcccgggttcaagagattctcctgcctcagcctcccgagtagctgggattacaggcccctaccaccacggctaatttttgtatttttaatagagacggggtttcaccatgttggccaggctggtctcaaactcctgaccccaagtgatctgcccaccccagcctcccaaagtgctgagattacaggtgtgagccaccgcacctggcctcaatttcatttaaaatgctgtaataataaggcatgctcaaatgtgatatatgccaaaatttaacacactggcggccaggtgaactagttacgtggccaagttaaacagcttttgcgtagactttagcataaaacttctgccattttcacttaatggaagactcttctgggattgcaaggcaggctattaaaaccagtcctgtttggaactacttctgtatgaaagaggattatacagaaattgtctaaaacaaaatatagaaacaaaacagaagcttagttgatactatttaactaccttccacaattcttaattttgatctgttgatcaactctgttttgttctaattttttaacttaataagtaaatgttaaaaatctgaactcctaaaataactatagttttcaagccttttgaaacattgtttatatactaggtccaaattcgtttgcattttttttctaaaagagggctccgctaataaaattttacaaaccaccgctctatctgatgtctatttctagattaaaagtggagcgcactcctcagagagcctcccttgagaaacagcacagataactgaaactttccaggaagaatttaagaacttcacatctcttaagtggacaaaacactctcacatacatttgactggctattactactacacaggcacaaaaaagataatgtcccaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaagtttcctttttttaaaaaaagagggagaggggctacttctgttctctgtaatgttgaatgctcaagagtggcagttgataacctaaccagacagaacgctccccatggtagttttctcctccaaagaaaagagcttagaagctttctctttggaacagaagagtcctctattcctttatttgctcactaagtcattagttaaactatccgttcatgcctcctaggtttcagccattctggatccaactggacaagtgagtcacaagcctgccctcatggaacttaccctccagtagatccactttaggtaacataagatggctgtgttatgtccagagctttctcattgaaccatcacgtcaacatgtacttggacaagaaaatcacctctttgactctgtttgctcacctgagggatgacaaggttgaccctgggtggtctaacagggccaccatgctaaggctctaagttggacaccttcaatactatgaatagcaggaattgttaaagaattaaaccccacccactctaaaaagactgtctgatccaggcttccctgaatcttcacctgggtgattatgatcaaggttcttctaccaccaaacacaataagaaatcaaatcttatcagaattgagctataaatctgtgaagactccaataatttctagccaagggaataacaccacaaaagtactttttaaactaattactcagattctgaagtgctgccctaatgagccttctttctgcccagaacttactaagaggaaaaactaccttctggtgcagtaattactgctttccccttcaaacttctaactggagatcgatgctgcattttaagacccattgatttacaattagcctggctttcctgctaaagtgttttttaagcagagtttacttttattttattttgaaatctctgagatctggttcttggattttacattctcatgagaggagactggaaatctcaaaagaggaaggtaggcattggaagagagggcagtagaaggatgcaaatcagattcaggagggcggggaaggaagaaaaggaagttggtttggtcacagaattttttttttaaaagccaaaactcatgctgaaagggagagaatgaagaaatccaaagagaggaagcagaaggctgagcggcaggaggagagagctaggtgcacagactaataaagtgtagctgctgtcaaggtggctggaatagctctttatggcctccgctgtttattagcatccttgagaaggaaaaaaaaaaaagaaaagaaaagaaaagaaaaagctttgtgcatctttgcaaaacaaagcactagttaaaaatagtgtatgcagcagggacagtgtgctaacatgagggtcctggcagctccagcatttgcacaatctgtcccatgaggagagcagaagtaagcgaagcaattaagaatttcatgctgattgctctaagcatgttttctatgccataaagatactagcataaaggatatggccttgcttctctccctcccctgcctgctaacttttgccttctagcttttggacttttccttttctttgcctcccatgtttgaggattcgagacagtggttagccggcctggcaccactttatggaatctgtcacttctataccgaaagaaatggcggttgtgtgcgagtctctccctgcccttgatcaagagcaaatctggaagaggagatataagccaagctgcattactaaagccctaaagagggaaggcttaaagaatggggaaactccctctgaggcctacaaatccgggctctccaaggcccctcctgccactcccattctggctcttcactatttctgggtcccaagaacgactggcagaagatggtcctggacaaatgagagcaaaaagtaaaaattcccaaacaataaggggggagggacaaaccacaaactttttgcttttttaaaaaatgtattttatagcaagattggataggccaatttcaaagactaatatgaaaaaagtgcaattaaatccttgaaaaactgacagatcagcaaaacaaaaccacccggaggagagcccgattgagcctcattaagagggagttcagcctgtttttaaaacccttcttaacacttagctgggtacctcccagcagtgcgcactcccaatgcggctggcataattagtgtcaaaatggaaagaaaaaaaaaatcaacctaggaaatagaaattaaaacacaaattggtgggtggggggggggtgtcaaatggaaaaaacattccaaattcaaacaacaaactcctatcagtccatctgagggcaatggggagatagcaaaatactctactgtacgcagagataaatacgttccaattaaacagagagagggctggggcagattgagaagatttatgctgcaattccccatcttcaacctctccctcttctcccaaaatatattctacattgtggtcacgtcaactccacaaggctggggttaatggcagatggatggcaaattgcaccaacctcatcaattataaccatcatgcctgacaatggggaaaatgagatctggtgacaaatttccacaccttcagccatcaggatcccccaacgctggagcgcgtgcacgcgtgtgaaacagtgtgtgtgtgagagcatgagtgaatgcattacatatgaaaccaccagcctgtaataaggagatatggagctgagacccattatagaagggcaggccactaaggaagaaatactctggagatggaaaagatggcaggcagatgaagccattttattaaatcaggcaaattctaattcattctgcagagacagaggaacgaaaacggattcattctcagtatatcctctgagccagctcttatcacctcagcagagggaggagtgaaagaaaggttccaagattcatctggaaatcgagagaaaccttcccctttaaaaagcaaacattaaaatatatctatttcaataccctgcaccaggaatatggaaaataatgctcgcgccagagaaacgcaggggtccttctctggctttccaattattccagcacgtgaagaagcttacaaatttgactcattgcaataggaaatcagaaaggcaactgcagcctagataagttgttgacaaggactgacaaaagggattgtggaacatctcccccaatggcaagaaacgccaactgccaccttccccgtggtgggaacttaaatgtcgattttctagttgaaaacagtggaaaagaaaggccgtgtatgagaacaccaagcacagaggttgcctttcattaacaaaaggcgcttgtgtttagactgcaattagaaaaccaaggttttaattaaacaattacataaaagttagtttggctccctgtatagtccaacacttcaccagcgccttggggttagtttagcaatgagtgtttagagctctggctgctatgaaggggggaaagaaactgatgacacagcgtgcatgtaactgtaaagctaggcgctgtacctgtctgtctgcagctcccctgccatgttctagaacaaaggaaaagccaatgagactgacaatgagcacgcacgtggtcagaccacaagccatcagtaacatcgtactactcatggctgaacagaagagattattcaaagtgtcatgcaagacctggggggctcacgaggcttccggtgttcccaagtgaagagctgcgtctctatcaaagcacaggccaggtgcagctagcttactctgtgcctcttttaactaagagggatacgcaggagcttagatgccttcaaaatcccaaaccacctctgggaggagaagaaagcaatctactttttcacctgctgcttttacaccacctggagacagctgcccagggcagacagaggtacgtgtaggtccaagggcttagattcctaggggagacttcaatgtctaatcttcctagcacatggaaaactcctctgtggctcccagcaatcatcaacctcaatgctcaagagctgcaaaatgaagtgaaattagttcttccctatacacatcagctttgaagacagaaggtggccaccttctactaaaccatgttgcaggaacagcctgggccatctccacccttggtgaaatggattgtgtcaagtgagtggggcctggcttataaatacagacaggaagattgatcagttttcactccacagcacccaccaaaagtacacagacctcaaaaagcaaggccattctgccagtagggcagccagtaaggagaactccacactgacacccgcaggtgatgcttcagatcacacctccacaggagctaaatgcagccttatgtttccacaattccacattcccctgccttcccacctgcttggaattcttccagctctgaaaagacccatgtcaaatgataaagaatccaagatgggcagccagttgatactgaccaatggcctcatacattgcctagcactggactatcttcctaggcatttctgatcaagtcactgaaagaaaacctaaacaacagagctaattggttggcaagatgctgtattctgtataatacccaaggctaaccaaatcacaaggtaatcagtatttgttagttttcatagaggaccagccccatttgggtttcacaaggacaggaagttcctccacctacagagataacagaaaaataaaaaataaagactaagctgagtgtggtggctcatgcctataatcccagccctttgggaggctgaggcaggaggatcacttgagcccaggagtttgcccagcctgtgcaacatagcgagacttcatctctacaaaaaataaaagtattagccaggtatggtggcacatgtctgtagtcccagctactatgaaggctgagatgggaggatagcttgagcctaggagtatgaggctgtagtgaaccgcgatcgtgccactgcactccagcctgggtgacagagcaagatcctgtctctgtaattgacaaaaacaaaacaaaacaaaacactaacaaaacaaacttaattccaagttaacaaaagctgaggagttattttttcccaacttcaggctgcagccctgctaggtttgcaaagaaatgggaaatttaaggataactctgaaggttgtataattcatgccactggttctaaaaagcaaagttgccttccccaccaaaatccttcatctttcagacaaaggcagggttttcttgccgtttccaacacctgacagtgtgaactaccggagtaagagagcaaggaccagggcccgctgctcctcagcctgaaaggcggggcagccaatcagaactaatctctgtgctggaagtaaattcagtgttctcttccctgatctggtgcggcggggggctctgacggcaggggtgggcttgcttcccttggtgcccccatcccataccctaaaaactaacaagggcctttctggtcaacacctctcaccacaagcagccgtggaagaaattattttagatcaagcccaaaatgaaatccaaagcaacgaggctgactttatgacttatttatttatttcttccttcacgaacagaaggttaatataagagcaactccttggcaaacctttaagggtaattcaagcgacactgatgtgaatcaatgttccctttgtgaacacattacttggcagaaactggctttttgtaacccccttaaacatagccggcaaaacaaaaagaggggggaaaatgtccttcaaacaaaaggatgaggtgaaaataaagagagagtcgactgcactttattctctttcatagaagcaaatggatctggtgcttttatacattaatcaatcaatatcactggctgtacatcagcagggtagccaagttatgaatgacctttctggcaaagaggacacttttaatgctcataagactgctcatagcttagcaactttccgaatttatgcctgcatgattaccccttggaggcgagcagccgtgagtgctgcactaaatatggcaaggttagtcgttttcaatttgtgcagagggaggaagagatgtggacctggctgccccatttacgcacgagctgccgcaacctgggcgacacagagggcagagccccaggccctgcagcgggtcagggctggcctcccttctggaaagccggccgggtctcctgctcagcttcaggccaaaccaaacacggcagcttcagacagctcatctagaaagctgtgcccagctcaacttcgctttctgtctgcttctcacaatcagatcctgagttcctcaagctgacagccaggccggactggccagcacggggtattcccaggctccctccacaccctctgccctctggcttctgtgcctctgaaagccctccccacgttgattggactcctccaaccaggtcacagcttgatgtttccaaaaagcaatgagaactttcatctttgttttttctttttttaaagcaatccacagaagggcatttctaccgaaaagatgacgctctccagaaacaggcagcccacataaacaaactgttgggccaatcctctttcttttcccctgtcaccaactcagccattctcttcatgtccaaaaggcgagaaagttctctggattccattctttgtgggtggaaatggggcaaagggttgcctgtgggtctggatttctatgacaaccgctatcgtcccagagaggccgcaagggggcaagagacaaaatcccacctcagccttcttctcccaactcctcttttacagccatgtttaaagtctctggaagtctggaagagattcccaacttggacatgtggaagtccacttataaggccccacttttttctgtctcccatagagggaaataaagacgtttagggatttgaaatatagctttaacttcatataaattagaacagaagaaaccacaggctaaaactcattggccccactggagtacaaggaaaattcagcgcagaaacgagctttactgagaccatcctttagtctacaaggagttgcccagtgaggggagaatgcggcaggacatgggttagaggaaatgaacagctgggttgtggtcacttctggtaatggccttaagaacacaattgggccactccgtgttcatatttctgagatcagaagagtttacagaaacaggactccgctccaaggtatcactgatagaagcccccaggccgtaagacaggctagtttacagaaatggaagataaataacaatgaaaacaaggagaagagaagcttgtaaggacactatgcaggcatctccgaaggggtggcgagttcttatttccgtgcccctcgacatggtggacgtttgcagctcctagcccagctgggaagtacaacactccctcagcgttccacatacttaaataaataatcctggtctcgttaccgattatattttaacagatccagattcccatctagaaaaacggctttctgtttagagcagggaggaaaacacagagccccctccagctggtccccctgcagagctggttctgggatggtgccgcagacacccgcttcctgttccatcaggcctcggtggaacggctctgttttcccccaggaagctccaaatccacaaagtcaacaattcttaaaagcctgcccgctttcccccctctttcctttcagcgtttaacaaatatcaaacgtgtgtccctccaaaccaccttccaaatttacaaactttttactttttgagacagagtctcactcactctgttgcccaggctggaatgcagtggcacgatctcagctcactgcaacctctccctcctgggttcaagtgattctcctgcctcagcctcccgaggagctgggactacaggcatgcaccaccacgcctggctaattttctatttttagtagagatagggtttcaccatgttggtcaggctggtcttgaactcctgaccttaagtgatccacccgtctcagcttcctaaagtgctgggattacaggtgtcagctaccacgcccagccaaaatttacaaacttttaggtcccctttggagctgccaccctatggaccgccctcacagaacacaacacctcagggaaggggttggctaaatgctcagtcgtctgtcctttctcgatctttgcgcaagcctggctgttcctctgacagctctcaaaaattcatccctggtctgacagttaaaaataatgcatttattttttgtgtgcacaacggtgactttacagcctcccagggttttcccaagttacagacaccacttgccaccacttttcttcatcttctcttacctggccaacagcaacgggtcagcagatgcttttctcacgcaccttccctctcccatgcaaatgactccctaacccgccatccacctggcagacacctgtgtcccctgtgctgtgttgacatcacccttctggaagtgcttggtaccaactgtcccctacagccactgggctgtcttgtcacacattgccatatggcatgtcctcgttttgcatatttaaatcgctatatcaagaatattaacaaagataaaagggtatgagatcttcccactaagcatcgggtggaaattctcacattagtaataatgcaatgtgaacccaacccccaggatggagaagccactcagaagctggccggccatcctgttttgggtgcagtcccagacacaaggacaagccctccctgggaggcgggttactcctcagagtctggaaaaagagactgtttccccatccacgtgcacatttcattacaccagtgaatcctgatacctgggtaatttcaagcttttaccagagcaagagaacaccctaatacccccaaggaagccccaaacgcctcctggaaaaccagagtccaggaatggaaaaatacatcagagaaaaattctatctgaaaatgtggaattaccaacatgcaaaagatgccagaaccagaaagcctaacctgaaggtccacatattttgtaaaatttgcacaagaatagatagaacccgctgggcatggtggctcatgcctgtaatcccagcactttgggaggcagaggcgggcgggtcacttaaggtcaggagttcaagaccagtctggccaacaaggtgaaatcccacctctactaaaaatacaaaaattagccgggtgtggtggcatgagcttgtaatcccaactactagggaggctgaggcacgagaattgcttgaacccgggaggcagaggctgcaatgagtcaagatcatgccactgcactctagcctgggcaacagagcaggactccatctcaaaataaaaagaatagatagaactggaattttctgtttcattgtcggtgtcctctgctccctgagaccatatgctctgtggggaggaactgtgtgacacactgtataccatgcaacttcaagggaaatcaatcatgttaggccactgctgaatacctccaagggtttcccatagcactgaaaccccaaacttaggaccctgcttacaaaggtgggtctggtggtagatgccacccacctcagccctccctaggacaccaattgcactggcctaccttctgccccagggcctttgcaccaaccaggccctaagcctgctgtgttccctgccttcttcaaggtcaagtcaggtcacagcctaaatgttaccaccttaaagatttagcatttaacctgcctttgcagtattcagggtaaacaaatatttaatgaggaaagctttcccttgataaggagtagcccagctaataagtgaagaaataatagaatgagaatatcatcattttgccagctccaaataaataggagatttgggcaatgatcatcaatggctaataacatcacaaaacaatcagtgagacatgtatctcctgatcagatacactgactaacacacatgaagcagccatggagaaaaagtaaaactgctcctaaatgagatcaagtgtctagatttaactatcagttcacagaaaacacaggggtacagaagaacatgttcaacaatgctgtggggctataatcatcaaaacatccaaatcccgactgcagggatcctacaagatacatgattcagtttcttcaaccaaaattgcaaggaaggaaaaaaaaaagttagaagaggaacatacaggtaaagagactttagagacatatcaattcatgtaatgtgaacaccatgttggcatctggatttaaacaaagcaactatcaaaaaacacatgtattaggctgggtatgacagctcacacctgtaattccagcactttgggaggccaaggtggaggatcgcttgagcccaggagtttgagaccagcctgggcaacaaagcaagaacctgcctctacaaaaatgaaaattaaaataaataaaaataatccatgtattagggaatttttaatatgaactcaatatttgatgattccatgaatttataatttttaggggtctgatattgcagtcttgttaataaaaaaagagagatacaggtcaggcatggtggctcacacctgtaatcccagtgctttgggaggtcggagtgggaggattgcttgagctcaggaattcaagaccaacttggacaacacggcaaaatctcatctctactaaaaaaaaaaaaaaaaaaaaaaaaaaatttagccaggcatgatggtgcgtgcctgtagtcccagctactcaggagactgaggcaggaggatggcttgagcctggaagatcaaggctgtaaagagctatgatcgcgctactgcactccaacttgggtgacagagacagagagagagagagacagagacagagacagacagagagagagagagagaaagaaatagggatgaaatgatataaccaagatttgtttgaaaataattgagtaaacggaagcagggagtgaggggtagtgtatagatgaaacaggactggctgtgagtgggtatctgccgaggatggatgatgggttcatggggtctgctggttcatactctacttgtggatatgtttgaaattatccaactcaggaacacagatgatgggttcatggggtctgctggttcatgctctacttgtggatatgtttgaaattatccaactcaggaacacagaaggttcatttttttaaaaaagttccttccttctgcactttgggaggccgaggtgggtggatcatgaggtcacgagatcgagaccatcctggctaacatggtgaaaccccgtctctactaaaaatacaaaaaaattagctgggcgtggtggtgggtgcctgtagtcccagctacttgggaggctgaggcaggagaatggcgtgaacccgggaggcagagcttgcagtgagccgagacagtgccacttgcagtccggcctgggcgaaagagcaagactccatctcgaaaaaaaaaaatttccttccctgactatccctctacaacaggtacctcaacaacccctagtcacccatcttatgtttgattttaattctttacctgacccttatatttttttcttttgatttactcctcataaacccttcttgatgtaagctgcacaagagctggggcctggccacccacattgaccaccatgtctctagggctttgaagatacctggcacatgggaagcttcattaaatacacattagaaaacatagaagcacatgtacaaacaagaccacatcaatcattcagtagcaactcagagcgtcgtgctctcttgtctttgtaggaagtcttgagggggcgttcatcccccttcttaggaagatgtgaaagtattcccgggccacccaaacagtttaagcattgtatcttggcaacagactgtcatgtatcgatagacacacaagtaaagctttgaaatctttctctaaacttgtgaatgaagcaccaaataccatggacagagcagcagttgacctctcaggtggcccacactcttgggcctcactgcatggccacccatgttatcgatcagttgatcacatactggcacatcaggaccaccaattccaatcccaacagctatggcctatatcagaatccaaccaagaatgaaagccatcaatcatctacatagcaggctatttggaaacatccagatgttagagttttgaagatgatgcctagcgcaatctaatggaagtgttgttcaatttatgagccgtgatgatgccacctgaaaaatgagactgtcctgtaatcctggaggatgcaaataaagatgtgggccagtgcatttccagccaggatagcccaaatgggtgttaggtgaggccaatattcctctaccaatgaggctattttaaaaagtggattttgcattcctgcctactgtcaggatagtgacagccggctgaaccaccctaatgaattattttaaacagaagatgaaacattaacttaggaacctgagagagaggctttcactttcttaagatgaacctgtgacttgaaagagtctcaccaacaagtatttatggatgacttccatgtgcccaggcagggcacaagactgaggactcagttgagaaccaggtaaggtcagaaagggaagagaccaatgggaaaagggcttgtggctgagatccctccaaggtgccatccactagcccagcagaaccctcaatatacacacaagcccgttcagccccgagttgggctctgagtgccatggatctgtcttcaccttcatggcggccctgtgctgggccatatcaggcatttgggctgtgacagcccttgttaacagtagtgcttggctcgctctctggtgagctcccagaatgaacttggatcttgtccccacccaatgtgccaacccaagggcacactgacaaggagtatgctgtcataggctatagggacaggtataggcaacagaaagagaaggcgagtttttgctactgagatggagggtacctccactacctgtgactggccaaagaggaaggctgtgggttggaggtggtcagggtcacctccaaactcatcacaaatgagggcttccaccatcaggactggctcttcccaattctgctgctgaccaaggcttctgtatccacagagaagccctctgtggggctgtgtgccctgcaggctgaggtcatggttacgccactcatgctcctttgaggcatgaactctggagtagggctccccttgccctacacaatggaggaaacgccatgctgaagattccacatgccaccgggacagccctaagtgggaaagggagacccggggcttctctgagctcaacatactcctcccacacaaaggaagcgggtgtactgaggctgcagcccagaaagataatgtgatgcggtcgtgagatgcccaaattggaaggaggaaaaaaaggaacaaagaaatcactgtggacagatgaaatgaaaatctggcagggctctgtcctaacaaatgatcctaaaatgaaataacactaacttttctcctttggcagatacacagagagggagagtgagagcagtagccagagagggagggtcagaaagaaggttgcacccactatgtgccaggctccacactaagtataatgacactttatgtacattccctcacttaactgtcaaacaaagattaatgaggtagaccccctgagggtgcatttgcgtccccttttataggtaaaagaattgaggctcaagaagggtgcaattgggagcccctgaaacaaacatgtagacatttttttgtgcatgtgcattcatgagcattcttctggggtgagggatcatttctttcattagattacctgaaaaggtaagaaatcctcaggttatataacttgaccaaggtcactaagctcagaaaagctgggatctaaactcctatgtgacttataaaagcttctgcaaccagatctgatctgaaagcccccagtcttcactgagtaagaaagaaaaagaaatacaagagttgaggagatggaaaaggaaatgagatgggtgctgggtctaagtagaatgtccaaggacatttacaagcccctttcactatcccagaggttcttcaaagccatggcacctctttgaacatcttcagtgtacagaagtgacatgaaccaaccccacaacaaccccacccattcaccatccacacaggcacaaacccaccgacctgcagttccaccttaactgaagccagagaatgacctggaaacaatgggataagcaggaaatatccagattccctaaattatcatctctctggaagttctgcaaaatatgaacagtcattatcttgcctgtattgcttttcttaatttggagagggaactgtgtagaaagtaattaagagtgcacctcattggcatgaatgtttcccaccatgggctgaacagaagatgatgtggtgggtccagtgtcaagtctcactaagccagcatgagactgtccaggcggcatcctcaaccccacaggaagctgaggaagctgtcatctgtgactctgctgggaagaagctcagcattaattctactccaccaggtgtcaataatgtcagtgtggcatattatgtgattactctgagtggttacacaaaatttagaagaaaaaactgcactaacagcatcactcgcagagcagaactctggaaacgtgcactttacgcaatggagaagtgcactctgtctaatcctgagcaggaagatgagaacgattttataagtgtgtccccttctatctggaagattgcaagacacatggaacgcctttcagaagacaaaacataccaaaacataccaaaatctaagactgtaagaagcaacatcgtaatcccatgctaacgttaataccctcatggagtacgactacccatgagcaaactcttcttccatttattgttgacaccagtttaaacatgtaatccacatttattttgattggatcatctatttttgctcttgcagtcatttcctgtcaagtttctagccaaggtgaaaagtagcgaacccccagagtagactctttgacaggggaaaaaaaaaaaaagaagaagaagaagggatgctgtctgtgcccaggcactattttcttaaggtggcagctttcctcttctaatgatgcctctggtcactgcaccaaccagttgagtcggtttttctggaaagttctcaccaatcactgaaaagggtgtttgtggaggccaaaaatggtgacaatatcaagagccgcacagagtctgccaaggaacccacggggctccgacaagatggcgcccaaggaagcatggaactaactgagccactgacgaatgggatagattctggacaaaagtaatgtaagacatgatccctgccccaagatgtttccaattttagggatgaatagtaagcaaatactaagtaatcagccaaacgaggctgtccaatctttttggaataacatgagatacataagtaatacataaatgtaattgggtgcaagggtcagtggtacagattcactgctatattcatttacaaaagtggggaatgagggaggtatgtgtggttttgatgataacatcattttcaccctcccttcttacccattcctgcccttcatcttattctctcccacttggagaatcagcgcctatccaaggcccaagctcacatcctcagatcatccttacctgctctcttccccatttctcccaggtggaaccacctaaaaacagcattaagtgtctcactctaacctagaccctctggcatcctgcaccttacataagctttccctcacattcttccatcttccactggggagccagtcttaccctctaaaacaaggagagatcaggtgactttgccaggtcccccagatctcagggctccgcactccctagaggggaaagtccttgcttctccccctccacccgttcgcgctctatctttggctacaactacatcccatgacctttatacactggcagatcttcagttttcagggtccacatcgacaggcttcttaggaatcttctcctgttagacagtgagattcctcaggcacagagagcctcctggtcaccttctgcacctccaccttgattgcttctccaggctcaaggctcagtagccctctgttcacctcaggagttgtaagaaacaaccctattgtacatacagccttggagatgaaagcaggaataattacctccagaaaggaagagtgggtcttggcaggaattctaagaatggacaggagaaaaagctgacgatgatttgacatgaaaggaagaaaaatcagaaggctgtatttccaaaatccaaataacagagaaagggtgaaaggtgaagatgagactatgctttctgagccatcccagggcaaacatctgctttctcattcatttccttcagataagggagagaagacggaaaggaaggcaggaaggacttcaaatttttaacagttttagtagagaaaatggaaaattaatcaaatgctattaccaggccttacatttaaaaaatactggggagactagaaacacgaaacagcaagcctggccctggagccttcactttcccttctgtgagctcttgcacagttaccagcccctctgccatcatccttcaaggaccagccagccagagccctcgccaaccagaggctcagttatagcagaacacactgatgagagctaaaggtgttttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttctaaagttctggcctgctgaatttcctgatcatctagaaaaccgggaaggggagtataggctaaaaataaaccttaatgaccaccactttcatttgccaaatatttctccctattgatttttattagccattttttcaaaacaatctcatttaaacagttcaattccttattaaatcatctccaagcatatcctcactagattctcattaattacaaagggaaaaatagtaacttcagaatggataaccccagaaggaaccaccataactaactgaccaaagctgatgcccgcaatcaagagacaaatcaatatcatgtatctcatgaaacaatacacgagaaagaacacgctttcttttttggcatttctaccaaaatacacagcctgattctaatcataaggaagcatcacatgaacccagttgaaggatacttgacaaaacagctgacctacactcttcaaatatgtcaaggtcataaaagggcaagacagaggaacaatgctagattaaagaatatgggccaggtgagatgtaatcccagcactttgggaggccaaagcgggcagattgcttgagcccaggagttcaaggccagcctgggcaatgtggtgagacatcatctctacaaaaaatacaaaaactagccagatgtggtgatgcatgcctgtagtcccaggtactcaggaggctgaggtgggaggatcacttgagcccaggaggtggaggttgcagtgagccaagatctcgccattgcactccagcctgggtgacagagctacagagctagaccctgtctttaaaaaaaaagaaaaaagaaaaaaaaacggctgggcacggtggctcacgcctgtaatcccagcactttgggaggcagaggcagacagatcacggggtcaggagatcgagaccatcctggctaacacagtaaaaccctgcctctactaaaaatacaaaaaattagccgggagtggtggcagtggtggcaggcgcccttagtcccagctacttgggaggctgaggcaggagaatggcatgaacccaggaggcggagcttgcagtgagccgagatcgcaccactgcactccagcctgggcgacagagcaagactctgtctcaaaaaaaaaaaaaaaaaaagaaagaacatgaaagaggacagctaaatataccttgtgatctaagatattcttttcatacaaaggatattattaggaaaatttgaataaggactataataacctaatagttttatagcaatgttagttctctgattttgatcattgttctgtggttatgtaaaatatctttgttcttaggaaatacacactaacttattttgatgtcaaggggcaccatgtgtgaaatttactctgaaatccttcccaaaaaaatggcaatgtgtatatttctatttattctccgtctttatggagagagtaagattatgaatgcgagagagaagtcaaaaaaggaaatgtggtaaaatgctaatatttggggaatgcaggtgagagaattttcttactatgtaaagtacattacttttctataagtctgaaattatatcaacattttatttatttatttatttttgagatggagttttgctcttgacgcccaggttggagtgcaatggcgcaatcttggctcactgcaacctctgcctgccaggttcaagcgattctcctgcctctgcctcccaagtagctaggatcacaggtgcctgccaccatgcccggctaattttttttttttttttttgagacggagtctcactctgttgccaggctggagtgcaatggtgcaatcttggctcactgcaacctctgactcactggttcaagcaattttcctgcctcagcctcccaagtagctgggattacaagcacgcgccaccacgcccagctaattttcatatttttagtagagacggggtttcaccacgttggccagaatggtcttgatctcctgaccttatgatccgcctgcctcagcctcccaaagtgctggaattacaggtgtgagccaccacacctggcctttttaaaaatatttttagtagagacggggtttcaccatgttggccagggtggttttgaactcctgacctcatgtgatccgcccgcctcagcctcccaaagtgctaggattacaggtgtgaaccaccaagcctggccaaaattttaaaaattttttaaggaattggctgggcgcggtggctcacgcctgtaatcccaacactttgggaggctgaggcaggcagatcacgaggtcacgagatgaagaccacactggctaacacagtgaaaccgtgtctctactaaaaatacagaaaattagccaggcgtgctggtgggcgcctgtagtcccagctactggggaggctgaggcaggagaatggcatgaacccgggagtcggagcttgcagttagccgagatcctgccaccgcacttgcactccagcctgggcaacagagtgagactctgtctccaaaaacaaaaaacaaaaaaaaaatttcaaggaattacaaattgaaattaaaataagattcctaacatccccagtccaattatataattttgtattcttaagtattgcaattatatatattatgcatatttcagatgatatgcaaatttcatttactacttattgtttccatattgaggaaaatgttcaatgaaaacagagctcctatcagcacttgcagttcccctccaatacaaatagccccaaaatcaacatattattcccctctttaaggctttctttttactcagaattcaacatgtgaaagtactctctaggttctcaatttgtttaggagattacgagaaaaataggagttttcaggtatttgtgttttgctttttttgagacagagtctcactgtgtcatccaggctggagcacagtggggtgatcttggctcactgcaacctccgtctcccgggttcaagcaattctcatgcctcagcctccggagtacctgagactacaggcacgcgccaccatgtctggctaattttttgtatttttagtagagaaggggtttcactatgttggccaggctcgtctcaaactcctgacctcaagtgatccacccgcctcggcctcacaaagtgctcagattagaggcatgggccacgtgcctggccatgtatttgttttaaataaatctatgatattcacactcacctacacgcctttcaaaagatggtggggggtgggggatgggcaaaactagacttccgaaagatggaagaaaatgggattgcaatttttggccctgcccaagatcctctctttaggcagaatggcctgctcattggctcccgaccagagtcctgaactcccacaacagcctggggtcttcttcctctgtctctactgatttatctttccagtttcagcctgactctctccttagagcttccccaccattcagtccaggaattcctcaccctcgaaggcccagagtatttacttcctgttccactctctgctactcactacggatcatcttgaaccctgttaaccttcaatgggcgtatttttcacatccttccaaaagatcataggctgggctcatttcttctgttctttttatattccctcacagcaaccagtatttacaactaacagatgtttaataaacagctgcaaagctcaacatgccctaatgttttcaatgcaagaatgaaggggaaagaatgcctctgaatgactccaaaagcatgcttggagaaaatggcaaatgtttctgctgcacatttagaggccccagaatacaaatttgcatttgcacgacttcccttttcaatgagaattcaggtacgttctttcattttatcttattagtatgatgagatttgttcttgatgaatccgtaccacctcagctactcgtcatcattccattatcactacgtgtttatagattttcccttttattactcattttattttttccatcaagtatagttcatatacgaggtagtaattaccaggttttctgctccttacacttcaagttcgccaatttttttctgatcataaaagcctaagtgcctattgtcaaaaatcttgaaaacagagaaagtatgaagacgaaaattgtccataatcagtgctgtcttcatatagatattttaaaggaaactgtgacaattatatgtgtttttgggtcttgctacccacccctcagtctacggagcttgcttccatatccttaaatattaatcaagaacattattcttaatggctacacagatttccaccacataatcgtaacacagtttacttaatcttcttatattttaaaaggcgtatggctgatgtttctaattgccttcgtaataagcatacttccttgctaacagaacactcactttattcaaagcacaataccctcagccaaaacctgttgtctgttgtgcccgaggacagtcatatgatgcagtcccagccaatgagatgtaagataaagcaagtgggcggggctttggaggaaacttttaaacaggtggtctttcgtgacgcatgcactctcaccagcctcactttcttgtgcctggagctcagatggaggattttttgattttttttttttttttttttttttttttgagacagtctcactctgtcgctcagcctggagtgcagtggcacaatctcggctcgctgcaaactccgcctcccgggttcacgccattctcctgcctcagcctcccgagtggctgggactacaggcacccgccaccacaccaggctaattttttgtatttttagtggagacggggtttcacggtgttagtcaggatgcgatctcctgacctcgtgatctgcccgcctcggcctcccaaagtgctgagattgtaggcgtgagccaccgcgcctggcctggaggagccatctttagaccatgaggaggcaacaagcgcttggtgagaatggctacatggaaacatagaaggaaagtggatgtctgctgactcagtggaaccttcacttctgcacctgactgccctcctcccaaggctgcttatataaggaaaaatgaaacctctttttttttttgagacagggtctcgctgtgttgcccagggtagactcaaacttctgggctcccagtatcctcctgccacggcctcccaaagtgctggcattgccggcgtaagccaccacaccatgccctcctaactcattaaagccactttggagtgtttctgtgatctatagctgagtggtgtgaaacaaaagaataacctttttttcccccaccttctgctgtcttcatagcctgtgatacagcttcaaaaacaaggaccaagacctacacaccacaactgctggggtcatccagtccaacctgggacagaagtcctggacaggagaggtgtcaggtctctcttcctctgaaagggggctgcctaacctgttgatgctgtgctcccatcaagaagctcacagagaatgatatgggccagtgtttgttccgttttagtgctcatacaactctagctgagattaaccaagaaaactgccccttactggctcagggaactcccatagagaattcccatagggaactcccatagggaattccaaacttacaggccagtaaggtggcctggccgctcttccacctggaacacagctcactgaatacggcagatacctgcagactgggggcagaaactgggctctggatccctttcccagcggggagacctggcttggttgtgagcccagccctgcagggaggctgcagatccaacacagctcctcttggaagccctctgtgccaggaggcacagcccagatgccccgggaatccctgagggaaatttcataaaacatgtgactatctacacagcctgctagaggccagatcattgctcacacggctaagttgaagcctcagtgcagtttctacttcattcagggaactggagttgcagctttcactagaagagctgcttctccttgatgaacaaaccattccgcccataaaaatgctgtggaaagtactgtaaacgctaatgcagccaaaaacttaaagactggtatagggttaactgaactgccacgttaagtcaggtgtaacgagatgacaatgctttaatcctgctgcttaaagcgatgtctaaaatgtgcaagtcaaatttcaagcctttgtaagaacataatggtaaagataatttcatcattatcaggtgatgcaacaacctgcccggtcccagggctggaattccaaacagtcacgcctttgcagagttttacagccctggaagagaggggaggccacagtgaacacctgtgatgataactccagcccatgccccggtgatttttgacaattgaattaatgttgaaatgagcttatttttctgtcctaaagggaaaacgagcctaaaatcctgttaatctagcatcctggttactcagtttcaccataatttataggatagtttttctatccaaaaactaaggctatttttatcccaacttcgccgcttcataaaacacacgtgcatgcatgcaacttcagaggttttggcctaaagcaagttttcaaaataaccgggttcaaatatttcattgagatggtaggggtggaagaatcttatagaagcaaattttactgttctctgtaaattcagacttcttcagccacagatggctcagggatccagtctcgcttgagaaacatgatggaataagcccacagtcagagcttcttctcattcagtttcatgaaagctctgagctcccacaagtgtctgctggaactggacaggaagcttgcaagatgctggctacgattcagcgcagtcaccgccttccccagtcggcccaccatccccagccatccaaccacttcctccccacgaggcatcgcccgttggaaagttttattaaccaaatgcttgagggtttctgtatatttatattacctcctcttctctcctgttctacccaggcatgttgaaaaaaaaaaaagttatgatatactttaataaaaacaaaattaaaatgattaaacctttcatatcctttagagataatctctcttctcctggctggtccaatctggaagaaaacaaatgtgaaccatagcttgctgctgcttttcaatttttttcccccctaaagaaacaaacagaaaaagccgcctgtggccagatttttaaaataaattaaatttgtcctcacacacggcagccaggtgtggttgaaacattctttccagatatctatgatatatgccaacatccttccctctgggggtctttcaacgtgagcctgacaatcccaaggggaacagagacttggcgggggagaaaggggggtgattccaaaatagttattgaaaaagaatcactatttcccaattagccctgtaataatgccttacaggaatgactggatgccctgcccctgcacgccatctaccaaaaccaaaaaatagtctacattcctgattaaagcaaagctcagagaaaacagcccggtatggcacaaatctccccggtcttatgtgttctgaggaagtcttcagatccgcccagggtctgggcacaggtccgcagggaatcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgttgttgttggtgttgttgttacaatatctaatagtgagatcaaattcttattgtggaaataaacatcacggtcttctgtatgaagatggtctgcggaaagtgaccacgcatcagagtgtccagcgtaggaggagaatctcagtttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggtttttagaaaaaaaacttctgatccctgggctaaaacagagagccccaaagagctatgttgatcccagacaagcacgtgcgtggattcttcaaagttcaggtcaactcaggcccctcctccttgcagtcagccctgtactcaaggttgctggagacatggcgcctctatttcctgcccaaagaagcccccttaactgggggccacgggttgagtggtgaaggaggcaactcacacctgaattatagtgggcttgtaaacctgaacagggcaagtcacaactttgggaggctgaggcaggaggatcacttgaggccaggagttcaagaacagccctgacaacatagtgagaccctgtctacaaatgaaaaaactagccaggtgtggtggtgcatgcctgtgctacttggaagactgaggcaggaggatcacttgagcccaggagatggaggctacagtgagccatgattgtgccactgcactccagcctgtgtaaagaccctgtctctacaaaaaaagaaaacaaaaacaaaaacaaaaaaacaaaaaaaactcacctaccaaaagtccagctgacatctactacaaaattcccattattgccataaaaacatgtgggctgggttcaaggctgcatagcagatggccaggctacatcctcatcacacacgcacttcactggtgccagtgccggtgacaggctagaagccactccagtgaggacccctgccagggccaatcagatcagggctgccctccccatgctgtggggcttctcaatgcttctgaaatggactcacacaaggaagtcacaaagggctttggacattaggaaaaccatgcaaactgtttccacttctcagagcaacccgaggcacgcgctctggagtgtgcagagtcacagataactgctgctgctttgctcaccgcagtcttaggatttcttcatttctatcctggagagaatccagcaatggatcacactgttatctagacacaaagaatcccacccctggggcaaagtgctacttgtcccgtggatgagtttgtcagcctgcagcaaggaggccagacgcagtgggaagagcacagccctgggccctgggcctctgtaccaagtccctactctgctgctgtctacagcagccctgtcctcaggaaccttctccagggaaggaaatggcttctgtctgcacatccaatacagcagccactagccacatggcactgagacagatgggccgctgcaatgggaacctagcgacatgagacatccaagattgccaggaagggtccgagttcgcctctgctttatgctcgtgcaggacaggaacggccctgtggaggctgccctcgaggctcacatcacaggctcaatctgggaaagaccagccatgggaagcaggatgtgacttgccctggaagcgcaagtgaaggacgggctccgaatgaaagctacacaaggtaacaatatacacactgggatctttatattatgtccagcctggagtatataacacagggtaaggaaaaaccaaggaattaaaagtccttcaggtacttcgagcaactgaaatcctttggatggaagtccagtcaatcagctggccccctattgaattctataccctaatgggtcatagaaaattgtaaggctctaggtagcatctaccccaaccagagcacaaacaccacacacaagcccagggagatctgcttagtccctaaaagcacagtgggcagcaaggaggggtttctatttcttttttttcttttgagacggagtctcgctctgtcgcccaggttgaagtgcaatggcgcggcctctgctcattgcaacctctgcctcccaggtgcaagtgattctcctgcctcagcctcccgagaagctgggatcacaggcacccgccaccatacctgcctaatttttatatttttagtagaggtggggtttcatcatgttggccaggctggtctccaatacctgagctctagtgatccgcccgcctcggcctcccaaagtgctggattacaggtgtgagccaccatgcccagctaaggagtttttatttctataaatccctccaacaggagcctaacacaggccagcctgctggagcaccttcagcaaaggcagcttttctcgatgctaagaccatcaaatttcacaggcacaagaaccttcctccacgtggccggctgtcagtcctcttggtgtttgccagcaagaaggtttcggtgagggctgtgtgagaacaggcaaggaaagagtcatggtaaaatgggctcagaggacacagggctctgaccccttttcctgtcctaacaagtgtctttgagcacttccggcttcatttggagtccccttccagcgaggtcgcagtagttaatcccatgccaaggccagcactgagaaccgtgtgctgcgagcaggaaaccagagaaggcctggtgggcgctgacagttctgtccgaggcgacttccaggatctccatgacctcccttcatctctcccaccaccttctgtcctaccctcctgccccacccaaagtgaccacagaaaaggaaacaagaaactggcttcagatatcagaaagtctgggtaatagactgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtcctaatcatacagagacacaccagggggactcacagagaccaggctatatgagaccaaggcctcgggagaagccaaaactgccggcacctggatcttgaacctttagcgtccagaactgtgagaaaatacacttcttttgtttcagccaaccaatggaaacggggggtgaaaaatacacacattcttttttgactttataatatgacaatttttgataaaattttgggttgaaacaacagatggccctgtaccaggaaaatcacacattgtctgatttttgatattctaattagagcagaggtcaaagatcttttaaaagcaataaatggctccttttattaacatatacacaaaaggtctcaagatagtcttgaggcataaaactataaaaacccatttaacatccactctgaaaaacacatctttacaaagtcctttcaaagtccctcaaaactgctaatggaataagacataagtagcaaaaagcaaaattaaatgcttatttgaagactgttctcccaaactgagaaaaactgtgaaacagagagaaagatcagcaagaaaagatgtaccctatccaggctggcgggaaccacacttctctaaaatgcaagccaaaaaatattaaggaaaatgtagccccaaacctagcctgggtctaccagaagtctgaggaaacccagtgaggaggagctgagcatggtccaacagaaccttctgaactgctctagaaatctgtattgtctaagttaaccatgagccccatggcactattaagcacttgaaatctggttaatatgatgcagaaactggatttaaaattttatttagcattaacagagaattttgagaagcttccttgtggctctcaggagaccagaaagcccaggaaccagggaggtatgggcagcacttagactgaggccacaaaactttccactgctcgtcaatgtttgaaaaaaataatttggaaccataattcttataattgggtcacagtttgaagggggttccttaacatctgtgactctgagaaaaagcctttgagctatttctgtacgcagagagatagatgcatgttctatttcctccctggcccctaccaaggtcgggaacaagtttcatataggatgtaagtagccctagaaatggattctttggacattcctaaagacggtacaggtacaaatcattatttctcgagaaacatccattcaggcagtggagaaagtgtgaactccagaggctaggataggggatccatatgggaggggtctgcacacatggcaggagacagcagaggacggctgccacttcctgctacactgtcggctttaggaggtctctcccctccagtgaaatccagggacagcacccccaaatccagggacagcacccccaactcccagcccagcacaaacacccactgactggctagctatccatattcactttagggtggagtttcagattttcaagtttcttggatacacctttcgaaggtgacttgggatgtttcgaaataaaggtttcacagaaagaacacttggtatgacatgatgtcctgtggctcccttgggggtccccatgtcactgggctctgatgagccaacgggggtctctggcatactcacacccctaaaaagaggacccccgcccaatgctcacccctcaacaaatgcaaacacacccatatactgtctctcctaattccaggaaccatcagcaggtacccctttttcctttttttttttttttttttgctgtgccaaaaaaaaccctctctgcagtgagtggccacagtatcaatgcttctcccagtgggcagcgttgggcacgtgctgccacccactcatgaagatagcatggaagacagcctggagcccttgaccaagaacaacactaaccagaagggcagtgtacagctggtgccacgtgtcatatgctgaaacaacacgcacaaaaccctggtagcttcatcatcccagaaaaataacgcaacgaatgaatggtggatctagaacatcaaagaatgagtgaatacgaatcactgcaactcaggccactgcggccaggtctagataactgctgaaaaggtgcaagtcctggaacagccagccaggacacaggaggctgggtacgaggctgcacgctcaacccactgcccacctgaccatcctggtgatgccacaccttctccagggggaccttccagggcagcagcgtctgacagcagtgaaacagcactgcatatgtccaccttccagcagaccagatcattagcatattttgcagagagcaagcagaaaagtttaattgcccttaattactcagttcaacaaggctcctagataatggctctcagatttcttgcctggtatcgacgtaatttccctgactctggcttcattatatccctaacttagaagcaatagcgtctccaagatggctttccagaacagacactgaagtgccagtgaggctgggcagtcgctacaaaggtttcttctatgaggagtcagatttttggccttcacaccactctggggtgtgtgtgtgtgtgtgtgtgtgtgtgtgtgtgtgtgtgtgtgtgtgtgtgtgtgtgtgtgtgtgtgtgtgtgtgtagcgggtagtggggaggacacactagcatatacttaggatggactaagacaaggaatatgtaatcagaagccatcacaattacaaatgtaaatgaacaggcaattggcactgacctttgcagattgttagaggactaattaaggcaaatcaagaactctgttccaacagaaaaacaagacagtatacaccctgagaactactcctatcctctctatgtaaatgcaaaatgcaggagaatcacagagtaatcaaactacgaatattggcaaataaaaaacatctccatgaacaaaagacaaccaagatttacttcttcgtagcctgttagtgattctgctaaaatctctatcaacaagcaccaccaccattctgagcccttgccacacatctgacattctgttagagtccatataaatacatcccaccgccaaaacagccagagacaccagtcactaactccttgcttgaatattttaaaagctgtaagaaaaatacttacaaaaaggaatcaacctatgttatcctgtaaactccatttttcatttaacaacattatgttctcttttcatgttcatacataatgacctctctttacccttgcattgtaaagcatctttctaaaaagcttgctgaaatttacaatccctgtccaaacagtccttcatcagggaatgtcctttagacagataaagtcatgttttccccatgcctccatcaatgcttaaaatttcagtcacccccatttgttttgatgcacttttacatttaacttctctagttaaaaatactttaagttcctataccttccccaaacccggtaaacaagacatacagtaaaaaggaaaggagaaagagcgtgggtgtgctgattttataaaaacaatatttcagaaattcagagctggccacaacatattttagtgctatcagaaaaattacactgaaattgcatataatttagctatttacaaaaaaaaaaaaagatgtactttatatttagagggcagccttacaccaactttgcaaaataaaaacaaaatcaagtgagaaagctgaagacagtatatattcttggtctcttaactcttaagctgtatacattaagcacaacaccctgaaacttggtttaaaaagtgattcatcaaatgaggccagtgagtgttgcagtaaaggctgtcaccaaaaccacattatcacttggcaagctgtgtgcacctctctggccccagaaattcgctactatgaatgccaaagacgtatctgtaaagggaggatactgctttttgctccaagcaaaacaagtctcttaaattctgaatgatcgtgcaccctctgtaaactgagtccgggtccaattatttccaatgcctgagctggtctagtcatcagtgtgtccatattgagagtgcagaggagatcagtgatcagctatgttctccaactcataaaaagccttatatataataggtcgtcaataaagaattgttgaactttaattacatgcatgtaaaatttggaggtctatgtctacatgaaagaaaaagtacttaggacaaggcgagtaagagagaaaacaggaggaggagaaggagaaaggccgacagcagaaacacaaagggcctgtgttctcaaagcccagggcacttgatagaatgaagttaactacagtttcacccaggagccagaaatgccttttaaataagcaaacagggaagctgatcctacacatgacccacctctgagagctctccatttttcaagagcttctggtaaaccagggaagcaaatggcagatgccagcaactcagagctctggcccagtgcattggccagtgatgacgagtggtttctacctgtgggtgggtaagtatgaaatgccgagacgaaatcccaaccaattccagagactacttggtcttgcagaaaaaacactcaagccaataaaaataaattgtggggattggaagaggaacctcacctggttagttactgtctttgagagatgtatttccaagccatttttaaaacaggaaggcccagcaggcttgtgtgcttgtgtctattgtggggtaggggtggaaaagtgtaacgacaaagaccatcacactgaaccaaagacaatttaccacaggactcggcctgcccactgacataagggcagagctccgccatggcagggccacatgggcacagaagcctaactattagcacacagctggcggccaaggctctgtccactggtgcagggcaggacttagatgtacgtgcccaaccacgaggcctctcaaggagttacgtagccagtcatggcagatatagatcctggctgctaccagaagattctgaagggatggaggagacctttgcaatttcttctacctcgactccttcctccagacccacaggttcacatgggttggcaggctacatgatgaactggaccgactggcaaacaagtgacttaagtaacaggtaaactgggaataggtattttttgtcatccacagggcagaaactattgcagaatcatccacagggcagaaactattgcagagttcacccctcctgccttaggaggagacatctagatacctgtaggaggtgacatgagactggggatgaggtccagaactcagaaaggacaaggggttatttctgaagggttttgtgtaatattctgtggcatgtggacaacagaggagaagaggaaaggagaaggaatgtcatcacttagcaggatgatgacagaaagccagaacttccaactctagacagcacagccatggatggggagcttctggtcagagtgggtggggctcctaaaaggtgcaccaagacttcctaatgctcctgatgccacaggatgacatttctagctgaaaaatcatgtcctgacccttatgttaaagaggacagagttgggaatagtctataaagtcgatgtttacaaaatttgaagttgatcatcttaaacatctcaattctaccaggtccataatgtccgttctcttgaagatatcctttcaagttttgaagagccaacccctggggagagggaagatacatcttaagatgagttttcttaaagtggttcctaaaacggaaccaagttcttgttaatgtcaatatgaataaataatacgtaatactttgtcccttttgtcatcagttatatggaccgaactggagcctgtgtgtgggaggggaggagtatggtgtagggagggagtaggggagagagcaaaaacatgactccaggtcaaagccaatcccaaagcatcttgacatacggaagggaagtctatcatctccactgaagttgctcacacacttctcgggggaaaaacccctagtatgcactaaatgagaggaacctcgaaggcactggtgccgggctgcatccacggaagcactacattccaaaacagggaactgtttgttccaggtcaccgactctgggtgaaatggcagctgtacactgtttagtgtggggcacctcattaatacaaaaggaattctgagcagagtaaaagaaagaattgaagggtgaaatggaccagcttttaacagatgattaaaacaatgatgtatgcagagctggccaaaaaaacaccccaaacaaagcacaaaccctgagcaagaaacaggtctaggtgtgttggtagaaagaaggagaatccggggaatgactcaacagtgcactaatgcagagcagcggatcaaacagaggccacaatccctgggtggggcacaggctcccctacagccagatggcccaggggcctcagcctcaggcccatcctcgtcccttactcctgagagtgctcccatgtagacggatgggatcagaggcaaagcagaagctccaccaattaaggtgtttcaactttaaccagaagaggcatttgaaaaacacatggaagggacagtcttgcagtgaccttcaagtgacaaaaattatcccggtacccaacagccctttcctgaacaaacaatttctactgactgtcgaaacctcaaccactctagcaaggagaaaaattcttgaattgtggtctatcccatcatttgggaattgctgtttcatttatatgaggaggcagcgaaggagcagtcagatgatccagagaggagcaggtgggcagagggctttggaggggcttaggagggacgcctccaggaggaaatgaagctgacagaaaaactgatagagcagagcgttcagagattaggaaatgtctacttctggcagagtaaggttcgccatgaattaatcataggtacctagaaaaccagagaaaacaataagttgtacaagaaggtaaatgaaattataaaactctacatggctcagctgcgattaatatttatagttataataatgaaaacactgaatattaatataacccccaattattatttaatcataatggaaggtggagggaggaaggactgagtgtggagggagctggggagtgggagggagtccaactgttgtgtggggggtgcaggagtgtgcggggcagtgcctgtgtatttgtgggtagagtgagggtgcgtgtgggatgcatgtcagtgtgtgtggggtgtgtgggggtacagtgtctatgtgtttatgatgcttgcatgtggggggtgcagtgtatgtgggggaggtgcacgcagatggggcgtgtgggtgtagtatatggcttgtgtgggtgtgtgagtgtatacagggggtgtgtgtgtgtacaacgtatgtgggtatggtgtcttgtctgtgggctgtgtatgtgagcgtggatggaatgtgtaggatgcagagaaagtgtatgtgtgtgcgcgcacgtgcgagaacgtgtatgaggtatcgggctggtgtgtgtgccgtctgcgtgagtctgtggttggggtatgggtgtaggtgtgtacacgggtgggtttgtggaacagcacactggtgaaattctcatctgcccaggtagaaagccaagaggtaacatctaaaacttaaaaacaagaaacagtcgtagaagtatgagaagaaacatggaaataagtaacaaaagaaatatctgaaagttgaaagctgatcccctggaaaagggggtgggagagggccatgctcttctccataaagtttatgtaactttttgcctttaaaaaatataaaaatgtgtaatttgattatattaaggttaaaactgcacacatccatgatggctgaatggctgagaaggcactgcaggagactgtaggatcaggagtggccttgggtctctggcttggccaggccgttagacaagctgccattaagaagaaaaagaagtgtggcagagaaagtggtgagccaggtgcccaagaggtgggaccaatgagatgtccacgaagctcagcatctgggaggtgggaccagtggtgtccaggaagctgtacaaaggcatttggcagcaccaggacacaaaagctcaagaggctgggagccgaggaccaggccacagtgccctgtgcccagggacatggggcaggctgagaaccaccagccagagtcaggcttgcagaactatcaagggaagtcagaggacaagagaaaaacaccccggaagccaagggaaggcaagggaaggggaagggagcttcaagaaagggctgggcaacaatttcaaacattgcagaaagaaaacagtcaggcccagcaggtcctgggctgtgtcaatcaaagatcagcagcgccctcccaagagtggcttggtgacagaggaaatgggttgtaggaggttgagacatggaatagaggtgagcagttcacagggttctctcaagaatctggaagattctgttgtagagacagtgtggggcctaggatgaaaggagagcttttcttggaaagttttggtttctaaagaggtaagtgactgtcttgtgtgtctaagtggagagcaagagactggaaaattgaaaaaatagaaaagaggaggtgattctacccaatgaagtccctatggaaggcggagtcatgggtggagggagggagggaggtggggaaaaaggtggctgcagggagatgacatggggaggtagaaacgaggcaagctcccactagcaggtctcgacgcattgaagcagcaagcagcatggacccaagaaacacccagaatcactcccaaatacaactgaaatttttataacaagcacttattttattcctctctaaagttcagttttacagaccagactttgaggccacaaattgactactcttaatactgggcaggacacacgatgtagcatctgctttgtcaatttgaaccaataaattgaatctaaagtatgtactggaggaatcttagaatagaggagagtatcttctgttggcctgctccctgggtagtagcttgtgacttccctaagactgagccttgctccaagaaaagtgctgccaatttcctttaaaaaaaaaaaaaaaaaagaagaagaagaagaaagaaaagaaaagaaaaaaagacagaaaggcgggcaggcaacaatccctgcatgttccttccaaaacacaatgctcacctgtgaagtcagtaaggaacatgaggaccagctggatcagtaacgtctccctcaaacagaagtcctctggaggtctcaaggaggtgaacacccaggcccaacctgggcctcccatgcctgtgagaccactcacctgggtccgtggaggggcacctgcggatggtgaagatctgccccaggtcctcgtcctcctctggaaggcccttctgcagccgctgcagctttcgcaggctctcgcttcgctggtgcttcatggagcgcacatgctggatgaggttgagcttggccttggtggagtagttgcacagaacgcagtggtagtagcagctctcaccttctacaccactctcatgctgctgcaggtgctgcaagtaacaaaagagaaagacatgccttgggtaagccactcgaagcggccactggcatcagcccacaccatcctggtcacagccagaggcatgcctccaggggacacatctccacagccaaacaggacagtctttgatatggtttggctgtgtccccgcccaaaatctcatcttgaattctaatctgaactgtaatccccacgtgttggggataggaccttgtgggaggtgattagaatatgggggtggttcccccatgctgttcttgtgatactgagttctcatgagatctgatagttttataaggggcttttccctacttcactcagcacttctccttcctgctgccatgtgaagaaagacatgcctgcttccctttctgccattattgtaagtttcctgaggcctccccacccctgcagaactgtgagtcaatttctttcctttgtaaattacccagtcctaggcagttcttagtagcagcacggtaatggactaatgaggtcttcaactgtgagattccttagagggtttttttttttttttcccccagagtacccagcacccttctctagcagttctttgaaaaaacacagcaagctgatacccattcctatctcccccaaatggccccagccatgtggcttttcagaatgttgataatcctgatcacatgggccctcccagtgcaacaccggctttcctggcacaaggttaaaggtttccccttttattctctaaagtgtcctgctcttgttagatcaggggttggcaaactatggcccacgggccaaattcaacccactgcctgtttttgtaaataaagttttattggaacacagccacgtccattgatttacatactgtctatggatgtttttgaaacatcagagttgaacagttatgacagagatggtatagtccacaaagtctagattattactatagaaatgtgctaaattatgacaggaaaagttaagccaacccctgcttcaggtaatagcctctggtcatcctgcctgtatggcaccctaggtcaggaacatggagccggagctggtatctggctttttcacaagacaactccagtgtttgtatttaaaaccacagtctactgggagaaccccaaattaggttttcacctagattaaaaaatgccagaaaaataaatttctccagactagttccctgtcaatatctcaaagtcccctggcttatcattggccaatatcattggtcagttggtgtatcagatggtcagatggtccaaattacgtcctctgttgtacttagtagacacagtattgatcccagagcatggcagcctaagagcctccaggaggcaggcacagacaggattcatgtctggggtatcagaacagaagaggtcatgatgcagacaggtggcagaccccaggcttctgtggctaggaagacttaaagacgacccaacaacaaaactcacaatgtttctgagtctcctgggaatgtaatgatagctatggaccctttttgactaacagagaatgaatgtgcacctggtgtagaaaggccatctccttcattccaatgattcactttaggggaagagggaattcttccactgggtacacatgaagcaagggaaacactccccaaaagcttaaatgactgacccaaggtaacccagttagttagggggagagagagatgtagaagctgaggcttgtctcctccagccatgtacccagcatccttttgaaggaggaaattcaggtcatgtgagtgctttatgtgctcctgtgattacgtgtccttccttttttctcctcaccacctgtccccaacccccagcccagtcagccaagcctggcccatggagccatggcaggcacacaacaaacgtctcagaactgcccacgttgcttgtctcctttctgacccacactgcttctgtctgatgtttatgccaggataatggtttctagtcctgcttggatgtctcatccttgtccagcttagaatgcaagacactgacaagctagaatggttagaatgccctgcactccacgcaatcctgaaaataccagagtggccctgtgagtgcttcctatcaagggacactgccctgacgctcacgtactgacatgcacacgtcctgtgttcactgatcacgtgtgaaaaatccagaagcatgtttgtactttgctggaagaagaaacataaatgcaccaactaagtgtcacagaaaactcatgggaggggggttgaagccctcaatgacataaactggctaaagtatcccacaggaaatcttgccaacttgtacgtaagaatgggatgagcttcacaggcaccaagaaagaacaatcccttctgcccccaaaatgggtgattcacacactcatatgcagcaccttggacaaagcaaaatttctacaaccagaaagtattggaagaaccagtgagtgcaatgttacctattagaaaaattacaactggtgataaaaagctacttttctggagataaatttgagctgctttttgtttactttttatttattggtttttttttttttttgagacagggtctcactctgttgcccatgctggagtgcaaaggcttaatcttggctcattgcaacctctgcctcctggattcaagcaattctcctgcctcagcctcttgagtagctgggactacaggcataagccaccacacctagctaatttttgtatttttagtagagacagggtttcaccatgttggccaggctggtctcgaactcctgacttcaagcgatccacccgcctcagtctcctaaagtagctgggattataggcgtgagccaccgcacctgacctctgagctgcttttaaaaaatgatttaacctcactgccttctctgtgatgaggttcctttcagaggatgttgggaggatgggatgcactgaggcagtgctttctggaggttacaatcctggggagaaggaaggcagaagtgaagggagaagatgagctagcccacgtcccttcccccaactactccccgaggcccctcagaactcagaagccagaaacaggaccaggatattccaggcagcaagagtttgtcctaaaaccgaggagctggaaacctgtaagggagccaagaactgctgtcttaggtcaccaggaccaaaagaatgatattcattaaagcttcaactaaaactgagtgaataaaagatggcagagacaataaccatgaaattcaaagaaatacgttccatcaagagattttggaggtagaataaactatgaaatcagaccaagaatcactaaagccttacctccaatccccccactacctccctatgaaacaggatttcctcacaataaggcactgaatttcaaacatcaaatttgaatatggatgtgtgagagttctattccaaatggctggagtcttcaatctctgagccacaagagaggaataacatggccagaagagttggatggaaatgcgatgtcaaatgtccaaatccatgggctcttgggtcataggaccgtataaaccctggattgaaataaacatcataccgggtactcacactttaaaaaatggatatgataaaagatattctaaaatccactccacactctagctcatgttggtaaactacaatctcttacactgccatgaattattctgtctgccactttgagagccattttagcaagaaactgggcatgcattacaaatagtggagaaaagaataagaggaaacaagaaaatgaagccacggctgctcccacctaacctggtccagtgaacacctagggttctctcctagaaaattcatgaaagattcattcaaaattccaagcttgctttgtattccaagtttattctccaaaacacttaaaaaaatccagaataggccggatgcagtggctcacacctgtaaacccaggactttgggaggctgaggtgggcacatcacctgaggtcaggagttcaaaaccagcctggccaacatgatgaaaccccgtctctataaaaatacaaaaattagccaggcataatggtgggtgcctgtagtcccagctacttgggaggctgaggcaggaaaatcgcttgaacctgggaggcagaggttgcagtgagccacaatagtgccactgcactccagcctgggcgacagagcaaaactctgtctcaaaaaaaaaaaaaaaaaatccagaataaactatatcttggttgccaggaaacagctgtgcataaacctaacatcccaacccaaacttctgcttgggtctactatgtctacctgcatgtgacaagtcctgctctccccagattttccaagtgtctcgttatttcttaagttgtccaactggaagtaaacagagacccaaagctagcagcaaggtcctgacctctgtgaccttctccacatcattcggccatttcctaggccctgagcggctcaacccgcgaccctgttggtcagatcctctctcccttcctcccaagtggcactggcctcatccccagaatcccacccttggaacctgcctaataaaaagcagtggtagggagtgtgctaagaggcccatgagcactccacggggccagtcagtcagccaagaacatgccttccccgcagaagggagtggatgttttcatttggaggaggagggagaataatttgttcctgacccagctaattagaataccctcaattgggatcacaatgtatttaattaaattcactgtaatatatgaagaatccaccaaggcacaaatcccagtggtgcactcaagaaaggagctgcctgctttcagagttcttgctctcctcgccaggcaggaaatttttctcccacgcaaatcctgaattccccaaccccttccgcctctatcacagagtcacccgctggggaggagggcaaccgggttctgtttttactttttccattttctttactctgtgctcacaattcctacctactctcctttgttgggtcaggagtgtaattttaaaaagaaaacaaaacaacagctccaactgtgggcagtgtgctgggatgcatgccaaccggggacccaaagaaaaccagctggtgagcccatttggcgggggtttgtttcggtttgagtctaagtgtctacaacacgagacactgcatgcacgcgcacacacatgtgagcacacacatgcacacacactatgcccaaccccagggacttaacctgcaggtgatgcaggcagtgtcagcagcaactctaagaaaataaggaagggtataatgagggcattccccctttggcttgaatactgttttgagaatatacttcccggaatactataaaacacaggggcctcctagctaactcaagaaaatccagtatctccccacaaattactaatgagaaagcgagaccaaccagtatcttgaggtcatcctagctaaccaaaaaagagtgagaactcaggtctacccaaactcacttggttgggccaacctctccctataaccttaaatctgactatacttttccttgatcactcccactccaactcacttgcttgtttagaaagcacctggaggccaggcgtggtggctcacgcctgtaatcccaacactgggaggccaaggaaggaggatcacttgagcttaggagttcaagagcagcctgggcaacatggtgagaccccgtctctataaaaagaaataaaaaattagccaagtgtggtggcacatgcctgtagtcttaactacttgggaggctgaggcaggaggatcacttgatcccaggaggtggaggctgaagggaggtatgatcacaccagcgtactccaccctggctcacagagtgagaccctgtctcagtaaatagattagacagactacatagataaacagataggtagattagactagatagatagatagatagacggatagataggtaaaaacagacagatagcacctgcaaaagactggatcataagaactgcaaaggtactgtagctttcacagaaagaaacatctatgcttggcaattgaatttactttctgaaatcttggagaagtatgatgaaggaaggaagtatctagtttgagtcataaatgggagcagaaaaagaacccaacgatctccaagtcctccaaatgctgtgcagcggataacagactgtcctcatctggattaactggaaatttggcacacgttcgggggtcaacagctacggctggaaacgaagccagggttcatacgagggctcactcacgtcagtcaaagagaccttttcttgcacctcttcctaatcctattagggctactcatgttttaaaatgttcatcccgtctcagtttcgctggaagggggacactccaatgcttctgacacgaaaacatctcacggcccccatctgtctctgtgccttcccttctaggtctggctcactgagaagaacacagcaaagccctccctgcaaccagaggcacctcggataaaggggctggcgcgtaacaccaagcacaaaaagcaaactaatcattttaaaagaagggagacaacagaggctccgctgtgcgactttgtgggattctaccccattagtatgttgtgcttgttcagcctcgtcaaacactgaaagtcaaagagacgaaaagagggctcttgttagaaaataatgcatcgtgaaaatcaaaaaaacgtgttcctgttacttgtttcccagggaaaactaaccaacttctgtcagagaacattgatttctataaatctggaggggccccagctccctcctcctccccaacgataggaaacttctaacatctggttcctcatgcatggaatgcaaaatattgatcaggttttgtcaaagcctgccctttaaagtagaaacagacaaagtacattctgacacacacacacaaacatgcacaattcacaaacaaagcttcctcaggagtaccacctgttactacagacacacccgtggccgccctctcggcacactgtgctgtgcacacaggcacacacggcaactccatttccagagcagcccctctgagccagggggctattccaggagatgcgaggtgcttcctgcccagcagaggagaaaccccatggtggaatgtcccagaaaacccctgagacacctgtcaggccaaaggcaggcaggagagcctgtctgtaactcttctcagtccattgaactggaggccccatgatggaagaagctgcccgttacagcacccctgtccagggaaagacagcaaccacagcacgcaacagcttcagcttctcgcttcagggagaggactatgtaatctcactaacaaacctggtgagagggatggggagaagatggggaccagtaagtctgctaattcctcaacttgataagatgaagtaggaagacatagcgggtgttcattcaccatcatatgcatgcagagcatttactgtgggtgcggcatctacacacatactttttttcttttttgtctgagaaagggtctcactctatcatccaggatggagtgcagtggtgcgatcatggcttactacagcctcaacctccccaggctgaggtgatcctcccacctcagcttcctgagtagctgggactataggtgcgtgccatcatgcctggctaatttttaaattttttgtagagacagagtctgaccaatttgcccaggctggtctcaaactcctgggctcaaagaatcctcccacttcagcctcccaaagtgctaggattatagatgtaagtcaccgcacccagcctacacacacttttaaattttcacattacaaccccatgaggtgggtcacatttggttttcatccttggaggagcccaaagctcaaagaagccacatgactcctgcaaggtcacacagagcatggaggaaacaggaccagagcctgagacttgagtccaagtaccaagtccacagccgccaagctacgctgcacagactgcagggggttctggaacatgagactctgcagacccaggtgttcaccttgaatgcctaaaattaaaaagaaaatccttccaggggtaacgcaaccaggagtgggggaggttaattttttaatcagtcagatcgcgttatagttccaaatgtaatgtcacatttttaggaagactcctggaaggtcaacctaaatatatatgtatattctgttcaatgctggctttttatctgctcaagctctcgtccttgacgcatgctaatttagttctatttcattgtaggatccctgcagacaccataagatagaagccccaaccatgatttataagaaaaaagtaaaaggaagtaaaaatgttcccttagatcaatccatttgggttgctctgacctagtttctggtttctaggccaggctccttaggccgtggaacaagccatgattgctcactctccgtatccaaggccagagcggagacttcccgttcctctatcttttcccttgcacgaatcacatttcctgattcaaaattctcaacattagtggccttgagaaaaacagttaagttctagaaggaaaataactaagtctatagctgtctataggttgtacctgccttggctttgactctttcctggaaaaacacaaacatggatccttgtggaatgtcgacgcctccatgtaaacagatttcacttccctctgctaggagaactccacaaaggagtgtggagccactgtttatacatggggaggaaatttatcaggcatgcatttttaccattatgggagcaaattattaaccctgtctcaaaaaaaaaaaaaaaaaagtgtgtgtaggtgcttcgcccatagtaaatgctatgcatgcatatgatggtgaatgaacaccccctacatcttccttatttcatggtaggaccctgaggaaggggcctaccagatcataatgtcacaagcaaaatgaggactggtttccacaatggctgagtgagtgtgcacagagctcagaagctgaggggggtatgtaggtggataaaacaacaaagtgggtcccaccaagctaacctcaaactactctccagaaacaacctagagcttccagaatctgacaatcacctcttcactaggatatcatatcaggaacagcaactttcttcatttgtaagatgtacttcttccctagcactattttccagctttcccaaatttaggtccccatacaaaaataaaagcctcctgatatagtttggctgtgtccccacgcaaatctcatcttgaagtgtagtccccataatccccatgtatcatggtagggatctggtgggaggtaactgaatcatgggtgcagttacccctgctgctgttcttgtgacagcgagttctcatgagatctgatggttttataaagggcttccccactccttcactctgcacttctcttcctgctgccatgtgaaaaaggacatgtttgctcccctttccatcatgattgtaagttttctgaggcctccccagccatgctgaatggtgagtcaattaaacctctttcctttaaaaatcacccagtctcgggtatgtctttattaatagcgtgagaacgaactaatacaccgccatatacacattactctagcttgtgctcatccaactccacgtcaaactgttgccaataatgatggtttgtggggcactctagattaagcagcccagttgaaaaccctcactctgaatctcactagctgtgccacgtagggcaagtcacatacactgttgggtctcggtttccttgtgtgcaaaacagggacaataacagagcctcatttcactgctgggaggattcaatgggataattcatataaaatgtgtctgatacacggttagccttcataataaatgaggctattactaatgttatttttcatcagttaatcttcaggattagggatggaaacgaacatctactgaacatacctatttgttatttctctccttacaaccaaccctcactcctccccaggctccaaaaggcaatccttggttgacaataaagaaactgatatataggaattatgacatggacagaggatactgaacacacacagggctgccttcacccttacaagaagtgcaaaacttgccaaagtcaggctgttggtgtaggcagagcccagatccaaagcttaagcccatgcccttgccaaaaaaaaaaaaaaaaaaacaagaagtgtttactgggtctgtttgcccatcagggcaccaatgtaataaaatgcaaggaccacgttctttctcatgtctgccaatatcctgggtgaggagcagggaagggaggagagttcggctgaaatgcctggaagacacttccccgattctccaaatccactcaagaatttgcttatttgtatctccaatcccatgacagtcaatccagcagaaaaaaacacgtgtctactggtcaaaacgggtgtgctacttcatctataacctggagatattttacttgccctgtcttacacaaagcaattttaaaaaccgcatgagaaaacttccacatatgtgaaaatccttcggaacatgtgaagaactacccaaatatttgagacagtgatggtctttctactgtaagtccagatgttgcttcgtcgcttctgatgggcacgtacagccaggtgggcttggtgatggatgatgccactggtgttccagctcagtggttctctaacttgagcgtgcatcggaagcacctgggaggcatgctacgccctagatcgctggggccatcccaagggtttctgattcagagggtctggagtgagccccaagaatctgcatttctaacagtctcccaggtcatcatgacgccgatctgggaccacactttgagaaccgatgctctggccaggacagcaatggccacggaaaaaggacccaagtcggaatacctggagatgttctgttgcagggaggaaaatttccaagaccaaaaatctctgcacttggcttttcccaaagagtatcttaaattctagcaaactgcacttgataaatcatgcaatgcctgcacacaagaattcacctccttaatgaaaaagtcacacggaagcagctgcctgctactggcctgctccagatacttcataaaagtcagaattggctctattcatcttcctctcccctttcacacctgcactcgaaaatttcccagggctgtcgctggcagcgtggctcttgatgggaaagcatgaggcatcattttttcctcccttgctctgcagcccgctgagtgcacctgcccagatgtcttgctggaaccgagcctacagaagaatttcaaccaaatgcgagaggaaaatgctctttaaaactcctcccatgctcttcaactttctggttgttgctgcagagcatgaatttggtgctcaaacccagaggctcctcttgagttcctactatttgctgacaaatacattcatcaccttcataatgagagaagacagggcagccggcgcaacacaagcaggaggtaagcagcacccacaaggctgccttctgcctcgtacaaggggcttgattttttattttattcttctcttaaaagagagaatgagaaagtgacggggcgaggcagaaaaactccctctaaatcaacacttctggcgtcgatcactctggctgatgcagacatttcactttttctccttaaattccatttgttttctggaaggttgaaagagacagacttgtcggagggaagcaagggaccaacagtgaaatgagaaagatggttctttgaggaaggacagaagagtctgcttcaagaggccaggagatggctgtatgcagaacggacggccacgtggcgagagggccacagttctgcaaacgatgacactgctcatttcccagctctgcttttgggttcccccataaataacccagacaaacaccccatgcactgggttctgccctccttcccccaccccctttttaagtctcattaaaagccgatattgttccgcctcaagatggagagctcagcatggattttactgaacgttaaatcaaccagcaagcgcagccagcaaactctgtggcactttaactttaaataatgcaataattattgaatttcctttttataactgaagtgctggaatgtaaacaatggggctgtaattgcaggaaggggggatcaatagaggcaatcgttttcaaccatgttaattgtaaatacaattgctccaagatgtcagccttgttcttcttgctcccagaatcatcctaacggatgacagagtccaactttcccattacagctgttcgttcctttaagaggttctcaatcaggtctgatcaatctgtcaagataatgcatggagtaagtaagactcttccaaacacaggctcccaatcaatagcccggaccagcttaatgaggtggggctgaggcccagagggaggtaacagcccccagcttgcgcctgggtttggcaggctggcttcctcgcatggccctgataaacagatcagcccttaatgaggacattagttatgcatgcttcagcaagcagcaaggcacccgtccctggggacagacggacagaaaacaaaatagattaacagaaaacaacatggtaccaaattaggtctcactgaagacttttccctccttttcctgctttccttaattgtccagcagagtggaggacaccaattaatcattccaatgggcctgagcgcaaagacctatgggcatcccctggggtagaggatctcaagctgtccctgaatatgagcaccctcatttttgagacaccgttttcagagcacaaaggggctgacggggggctgaggagcctttcatggacgggccttagcaccaaacagccagagagatggaggacaaggctgaacctcaaagtctgacagtcgcgcaggccagccgggggctaaagttggacaggaacaaaaaccgccactctgaggctgatgtccaagtttctgaggccaagtcttggtcttgagaatggttattccttccagatgaggatgtgggaagtcaggagtcttgaatgcaactgcacccagcccggtactgcaggagtctgaattctcaccaggataaccagagagggctctatggggaacccatgaggaagggacaccatcttcccttcctcagaggccgctgtgcatttgttcctgctgcgagagttcgaggagggtgcccactgtggaggtcgttgagaaaggcccatgctaagggcaggtcccgccaagaatccagcagttcctttcatgcttggcttagagcagggagttctcaaagtgtggctcctcaaccaacagcaacagcaccctctgggaatgtcagatgtgcaaattctcagaccctgtccagatcgacagaaactctagggatggggccaggaatgtggcttttaacaagccctctaggcgattctgaggcaagctcacttggtggccactgtcttacagtgggggttagacaaggcaggcttctagtagggataacctcctcatatgttacatggagttggacctttctggatcggaaatagtccagatgcccaagatatagctagaaaaccgtattcttactgaggtttggctcagaggaggaactattattctagcccaccacccatctgctccagaatgcaaggcccccgggaaaaataaaaccaaaagaacacagaggcccttgtgacaactccattttattagttgagaaagatcatgaaatgggtcgcactactgaatttcagaagttaacagtctcatattgtgacagaagtaaaaacgagaataactgggtcttttgaaagctctaagggatcagcagactaagagaaaataaatataccgctagaaagatcagatccctgcactatgcagagacccagctcacagaccactcctactccaaagctgtccccaagccccaggctccatcgcttcctcctctgggcccttcagcccactggaagcagctcctatgctgtgcgtgttgcaaaccacctttgctcctccgccacaccatcaacagcatcccacaggctgggaccaagtcgaatatttctatcctcagttctcagcacagctcctgattcatggcagggacttaaaaactgtagtggctcacgcctataatcctagcactgtgggaggccaaggtgggtggatcacttgaggccagaagttagagaccagcttggccaacatggcaaaaccccacctctaccaaaaatacaaaaattagccgggcgtggtggcaggctcctataatcccagctacttgggaggctgaggcaggagaatttcttgaacacaggaggtggaggtcgcagtgagccgagatcacaacccactgcactccagcctggcaacagagtgagattctgtctcaaaataaataaataaataaataaataaataaataaataaataaataaataaataaaaattgtgggctgaaagtttgaacagatgaagaaaatccttctaaagctccactattcctcctgggtcttcagcttgcctttcaagacctatctaatccagtccaaattcacttcccccatctcagatttcaatcctccactccattccacttgcaattagacttgtgtcagttcccaccttccccaccaactatgatctttctggtctcagtgccttttcttgctgggaaaccctcccagataactctgacccatgctgaaatgcctcacatctcctacggcaggctggtggcacctgcgcctggaaggctttatgcattgcacctgagctaaaacagtggctccttgcctgtggggggggtcccacagcaccaggtggtcccgatcagggcccaccacaaagcattctcttttttctttctttctgagatgggagtctcactctgtcacccaggctagagtgcagtagtgccatcttggctcactgcaacctccatctcctgggttcaagtgactctcctgcctcagcctcctaagtagctaagattacaggtgcccgccaccatgcccagctaatttttgtatttttgcatttttggtagagacggggtttcatcatgttggccaggctggtctcgaactcctaacctcaagtgatccgcccaccaaggcctcccaaagtgctgggattacaggcatgagccactacacccggccctttcttttgtgtagatgcttcacttgatttctacacggggctctctgtccctcaatgactgagatgggaggttgggggctgaagagaataaaaatgtttgctaatatttattgcttgtttaaataagatttaatgacaggagataattacactaaatggctttattcagtgacttgaatttttttagtatgtgaatcacaaaagggctcgcccctccccaccaatcagccacaatgtcccccagccagaggacaactgagttggtcctcctcattccattcctccatttcttctacatccctagctatgttatttacataggtttactatcactatgctcctttactattaaactgacaaataattgcaagattcaggtatctgagcaccatcgagacgatcaagaccacagaagaaaggaagagggagtacactccgcagatgcctcccagggggagtaactcaggctgtcagaattctacatgtgtgcgggcagtgttcaccacacacacctttgcagataaaaagaatgtggtacatattttagttctaaacataaaatgtccacccaagccaacagagtggtgtgaaagtgttcagatacctggaaggcagtggccacacaggcattcctagaacataagacagcttgtctacagctccgatgagtcagaatgagggggacatcttttcaatacacacatcacacgtacaactttattttcttcctgaatttcctgtcctcctaatctaactgttgccagggactgctgctgactggatccccaagtcatataacccacgtggttaaggctctcaccttcctctactctccattctaggacctaggaggaatggaccattctctacatggggtcagagttgcatgttcagatgtgattccttccctctccagctacgcccaaactctgggatctccagccttctgactggccaaccccccgataagatccctcccgggacatccaagcaattcgatccaaagatgccgcctcctggttggtcagctctccagctcctagtggaatgagactggaaggccggcccgggaaaacgttttaaaacttatttttaagtggcaaaatacagggagaattttcaccagccagtccacactggccaaaacatcccctgcttacactcagtaagttcactgtactgcaggcccaagaaacagtgatgacacaggaagaagccgtggtcgatgatcgcactgggggggcatgggaccggggtggggagcatcgccaatcttattccagacagatgatagtttacaaaaccttctggagaactgtgaggaatttccttcagtaaaaatcaagtcttcagaaaactgcaccaaaaaagctggccgggcatggtggctcacacctataaatcccagcactatgggaggccgaggcaggcggatcacctgaggtcaggagttcgagaccagcctggccaacatggtaaaaccctgtttctacaaaaaagtacaaaaattagccaggcatggtggcacgcgcccgcagtcccaacaactcaggaggctgatgcaggagaatcacttgagcctgggagctggaggttacagtgagccgagatcatgccactgcactccagactgggcaacagagcgagactctgtccaccccccttccccccctcaaaaaactaatgactgggaaaattttctttgagcaaaatggtaggagttggggaggagcaaaggaggtgggtggaagcgaggactagagagaggactgcccagaccctgccaggtggaaagcatcaggacacatcacgcatgctacaagtttttatgtgacgcgtgcacagtggcatgtggacacagacctggccgtgctttctcccggggctacagtattaagatgcagtcaatcgctcaccatcacaccagtgggcaagtgatgtctttttggaatctcaaatccagtagcctgctctgctagccttaatctagtcagtctatggacgcttttatattagtaggtattttaaaggcttaagtcttaaaacacaaatctttcgatgacctttccagatgactctataatagcataaggccagaggaaacagcagcagccagtctcaggttctggtagcactggtatttttataatggtctttcttccggctttgattcattcattcattccccgtgtgtctgtctacattcctgctgcttctttcctcacgctctaatctctccccaaaatgagtgttcatcaatcacctctaaaaattatcctcatcattctctgtacgtgagaaaggcctttcactaaagggtctttatcacccactactcccctgtaccacccctgtctccagccagcagctctaccggttctcggtttccaaaggtttcctctatttgtgtgtgtgtgtgtgtgtgtgtgtgtgtgtgtgtgtgtgtgtgtgtgtgtgtgtgtgtgttgtgtgtatgcacacaggtgcaggctcaggccacttcctcctgtgtacaagtccatgctagatcctccaaattccttttttttttttttgatggggtctcattcttgtcacccaagctggagttcagtggcaggtggcaggatctcggctcactgctacctctgagtcccaggctcaagtgatcctcccacctctgcctccagagtagctgggaccacaggcccgtgctaccatgcccagctaatttttgtatttttagtagagatggggtctcatcatcttgaccaggctggtctcaaactcctggcctcaagtgattcacctgcctcggcctcccaaagtgctgggattacagcattagccaccgtgcccagcccctgctcctccaaattctatcctcctttctaagcatctcacctcccgccctttttctgtctgcagcgatcctttctcctctgaactccaagtcttgggctctcagcacggctatgggcactgctgccctgagtgctggtaatcagctttatgtatgtggcacaccccccagtgagactggaaggttcctgagggcagagatgctatgccctcctccctggggattgacacacaggagccacgtcattctgcagtgagaacatgggaatgggagtgagcagccgtggagaagagggaggactgacgctgagctttctcttccattgtaaaaggaggaatagggccacctacctcaccaggggccatgaggcttgagtgagaaaatcagtatgaatgaacttccttaaacaataaagcaaaattaaaacaaaacagctgctcaggtgacgacaatgggtggaaaggggaacttgaagattcaggacgcctcccctgccatctgatttcatcagggtcctaggactgactacacaaagaggaattgattacttgatcgtccgttcacttaccttgctaatgaaatcattgggtttttctggggaagaacctgttaggaggactggcttgcctctgggtgtcagtcccgctggtgccagctgcatccccaatgccaacatgactcatgcgatgacacaaattgccattgggctttgttattatgtgaccttcagcaagttacccgcccgtccctgctccagtgctaaaatcagcacggcgatacgagaacctacttcaaggcatcatcatgaggaacgatgatgaagcagctaataatgactgggaaacactttgtctttgtaaagagccatattacttaacatttagaataatacccactgtttcaggttgagaaagcattcagattttagctaaactgaaggctgagcacatccactaatgagcactgtccttcccatagaaacggcgaaagctactcagtctgctgaataaaatgactagcagtacattagcgagaagcggatgcaggtttagttaccatgaaaccagggccattgcattcaacatctaataagcaaattcttacgatcacagaaataagccagagcctaccgagctgacaacaattgcatgaaaagcggtttggggagaataatgtcttagtcccagttttcctagaattcataagaatacagcctcttagaaggcacgtttctaaaatgtaggcaaggggtcagaaaactttttctgtaaatattcagagggtaaaaaagcttaggtttttaaggcccgtaccatctctgtctcaactactcaattctgccacggcagcacataaaagaataggcatgactgtgttccaataaaactttatttatggagacaaatggctggctgtattccctcctctggcagtgatatgctgttccctgacctaaaaccccgtaacaaatttatacaatcatttagaaaaatcacgcgcctgctctcaataaagggaacatatacattatctttctctcacacacaccctcttaaacacactctttgataagcaaaataagtttcttacaatttttgaaactcaagttaagagccaggctcaggccgggtgcggtataatcccagcactttgggaggctgaggtgggaggatcgcttgagctcaggagttcgagaccagcctgggcaacgtggtgaaaccctgtttctacaaaaaaatacaaaaattagctgggcatggtggcgtgcacctgcagtcccagctacttggagggctgaggcaggaggatcacttgaccctgggaagttgaggccgcaatgagccaagatcgtgccactgcactctaccctgggtgacaaagtgacaccgtgtctcaaaaaaaaaaaaaaaaaaaaaaattaaaaagccaggcttgcaaacttcatatgcaaataagctgtttcaacgtgaaagtcaacacctatttaagagccatttaactttcaattacgaaatgaattcagaacaattcaacttcactgcttgttttcaaggctttcgaacctaactttctcgtcagtgtgctcagtcacagggcactggttctcaggttctgcatctcactctacaatcaaggtaaataccaccacaggaataagggttaaggttatacacttattcagagcttaacaatacctgtaactgacgccactttgaacgaacctagtgatggaattactaacaacaacaaaaatgtggccttctgagtctacgccttccagtagctgaaaacaatccagttttaaacagccagggaggaaaaaatgagaaggtgaaaaatcaggtcattatcatccctgcgtcatgccatgctcttgcttccttcctaagatgctcttaagagctgacgctaggacatccaagaatcttggatcctgacatctaagaacaagtgatcaggaaatctggattgagaaaaatgaagtatttaggtgttttctcaataacatcatcttacatgtacacagtcctgcgtagatttcaaagggtttggccattacacagctcaaatgattctcataagcaccttgagacattaggcagtggatggcagcgtggcagatggctttctcctctgtttaatggacacaggagagagataatctagagatggcaaattggcagtggctgagaagcctgcaggtgggagcttcataaccctcgggagtttttaaaaatgcttaattaatggtgaacatttaaaaatctgccaatttcccatacaatcaagattttttgcctctttagacattaaaaaacaaaacaaaacaaaaaaacagggtttctggctgtacattccctcatgtcagcaattacctagaaaagatggtgcaggagccctccagccccacaccagttacccacttctgatacctgtatggcccctgcaggcatctgggtttgcaatccctgggtccgaatgtgaaagagaatgtggctggcaagtaggagtcacagaagtcaaccctgggatctaccattcctcggctggggtttgtcagcccgtgctgtgctactccgtgaataacccagcacaaagattcccctacaaaacatcatgttgctgcctgggttgcacactgcaaaacagaaggtgagaagctcagcttcaccagacttgggcagtaagggagtcgagaatgagtgtagcttcacaagggaagccagcttaattctgccacaggagttaatatttgttaattggtagaaaaaggtaaaattaatgaggaagttagcatagctatttaaaaacagctccatgtttcccccactgtaacacatggaactatcaggaagtaattgagggaaaaggacactgtcaattctcaattatctgcatgaatgaagcgctcagtgacacggataatccaagtcacttacatttggatttagaaagtaacatctttttccttcggaaaacttaccttcctaattagggcttgctgaatgcagtggcgaaatcagtttaccttctcggtcagagaaacaacgtgtcggggaaggtttggaaacggctgggcatttcagaccctccgcggataacccagggcagataaaagatcattcacagaggctggccaatatagcagccactagccacatgtgactatttaaatttaaattaagttaaataaaatgaaaagttcaatccctcggtgacactagccacatttcaagtgctcgatggccccgtgtggctggtggccaccacgctggacagcacagatcacagaacatttccatcatcacagaaagttctagtggacggtgctgaattctagaccaacaatcacatctagttacctggattaagtagaaagcagagggcagggggagagggatgcgggagacgtcacactgccactttagaaacaaaagggaattgtaactccggactctctcagctagtttaatttcaagcccggtaatgtagacgctgtctagggaataacataaaaaataagcattccattctaagtaaaatgaggctttttaattaacaaagcagaaaacgggaggataaaaggcgaggcaggaaaggctgattttcagcaaacatgtgccattgctgcctgtacccagcatggccatgcagcccagacgctggctgaagggtagacaaaggcaggagctcgaccctgccaggctccgcgcggggaggtgcctgctcaggtgccgctgggagcaatgtcaggcccagtgtcacttaacatcctcattaattatcttgaaaggagagggttagtaaacagcaagttaattaaattctcagatgatgctaatttgggaggctttagaaagactggcaagggcagtggcaatataaatgggacctgggtgggttggaggtatgagtggaaataacattaagcgctggccaaacgctgctcttaaataagtcttatggaagagccaaaatacatctgaaaagaaacttatttggaaaattgttgcaggaaagctaaaaggttggaagcttctaaggcgtatgatcagaatgggagtcaaaaaggctttttaagactttgaataaaactgtttacgtgcacttagaggtctgggagaaacagcagctcctaagggttgctgtccttgggagggaggataggagcgaatggggagcagggatggggcttgcacttttacttccttttcttctaaatgaattaaagatttttattattattttattattattttttagacagagtctccctctgtcgccagcctagagtgcagtggggccatctcagctcattgcaacctctgcctcccaggttcaagcgacttcccggcctcagtctcccaagtagctgggactataagcacacaccaccacacctggctaatttttgtatttttagtagagacggggtttcaccacgttggccagaatggtctcaatctcctgacctcatgatccgcctacctcagcctccgaaagtgttgggattacaggcgtgagccaccacgcccagccctaattaaagatttgtaaaacaggcctggtttttgaattctgattttgaaatttttgtgtctgaaataacattagatttatagaagagttgtaaagatacaatgagttcccatgtgcccttcacacagctgcctctaatgtcaacatcttccatcttaacagctgggacactgtcaaagcaaagaaatgagcattgctacaatactatgaccaagctacagactttattcagatgccaccagtttttctactcaaggcctttctctggtccaggatccaaaccatgtccctgcatagcactgaaatgtcattctcctccatcgcctccaatctgtctttccttgtcctgaaagacctgggcgcttctgacaggggcaggtcagtagaggacccctcagtgtgggtttgtctgatgttttctcacaattagattgagattatggatttctggagagaatgccaccaaggggaaggacccttcccatccaccgtatcacatcaggggctatgtgacatcaacatgacccatcactggtgatgttgaccttgatcactttgttaaggtgacatctgctgggtttctccaagggtaagttaacacttttctttctccagactttactcattaaaaagagtcactaagcccagcccacacttaagggcaggggagtgaagctccaccttctggttattacgctgttaataaaataaaaacatctcgtaaaagagataaacttctctttatgcaaacaaaggtggctaatggaaatgtctatctagaaagtcagagtttgttgtctttgttttgcatacctgggctctcgacaatggaaatgaagcaatgccaagagattcagggccctcacagtgccaggccaggtgctgtgtagctatagatattagcccatttaatccccaccacagccagatgaatgagatggcacaagattacaacaatcctcccaaatgacagtaggtgaaatgtggaaccaagaggttaaatcacttgctcgtgttaacacagctatgaagggacagaggcgggatctgaacccaggccccctggctctagagatcatgctgtctagagacctctctgctatcctgcttcttgatatacaactctgaaatttcagggcagttaaaatgcggcagcaccatgtcactcccacagtggcactgtgagtgacagcgctaaggaggcccaacaaaaccaagatggtctggagggttttcaacagaagacagtccgccttcatctctatagtgtggcagagaatccagaacacattagcttggctaaggacctccctctctacaaacaggtatggaagaagctcagaacccacagaccacgatacttactcccatctcagcccctatctactacagacacaaacttggaactgtctccaaaaacatttagagttcactgtgacaaagcaataaagctcagaggtcaggaaaaaagcgatcagcaggcagacttgggggagaaacttggcccacaacacccccgatctacaacctgcaaatatttactcatgggcttgtttaatcctaacatttgatgttctgacattaaaaaagaaacaaggaagctcttgcttctagagaaacaagaaaggaacaaggaatgtttgggtaagaactgctgcattcttacccaaaagaataacataggctaggctgggtgcggtggctcatgcctataatcccagcactttgggggctgaggcaggcaggtcacttgaggtcaggactttgagacaagcttggccaatacggtgaaaccctgtctctactaaaaatacaaaaattagttgggtgtgatggtgtgcgcctatagtcccagctactcgggtggctgaggcaggagaattgcttgaatctgggaggcagaggttgcagtgagctgagatcacactactgcactctagcctgggcgacagagtgagactccatctaaaagcaaacaaacaaacaacaacaacaaaaacacataggctaacaagtagcctacgttattcaaaattcaaaattccagtactgatctttaccatcatcctgtccacagagaaaagatgatgaagtgtgtaggaagcaacaaatgtcccctacctgcacacccgccccacactggattctccaaatatctggcatttatttctcctccatttaaccctgtcttttgttttcccattgtgtcaactgcaaaaatttgcctttaaaaaaatgacactaataaagaatcacaccatacaaattctaatactatattgatcccatcagtgactgggcagacagcagatcttccatcaacacctagactcgcagaacacatcaaacagaaggctctcgacacccagtgtccgggatcagcgtggcgggcctctgctccaacctgtccacccaactagatctcaagaggaaaacagaattgccacctctcaagactgaggctacgtgcagtggctcacacttgtaaccccggcactcctggatgccaaggctcaagaggagcccaggaagtcgagaccagcctgggcaacaaggcaagatccagtctctacaaaaaataaaaaaaattagccaggtgtgtggtacatgcatgcctgtggttccagctactccggaggctgagggaggaggatcacttgagcccaagaggtcaaggctccagtgagccgtgtttgtgccactgcactccagcctctgtgacagagcaagactctgtcataaaaaaaaaaaaaaggctgaatttcattgtgattttaaaagcacatataatcattttataaaatgcagaaaagtgttattaataagttaatctctgagtgcttactatgtgccaggcacagttccaacgcccattctaagaatcacccactctagacgtaactacttaacatttcaaagtattcttttccatgcatttcaacgtttcacttcagccagaaaacataaaatagcattgaagagaggcatattttctgatttttaatggcatcagaagctggaaatgacggactggaatagtatacgtggcaaaaatctaaaataattaagaagatgtttgtaagcacttagaaaagagagcagtgaatcacttacagagcaagagactgacttcttccttgactcttcacttcccccccctcctccgcctttctttttctcaaataaggtgactactgctgttattactaacaccgaactgggagatcagggactattaaagattaatgacatttgattttgtatctcatgatatgcttgtgaacaatctggaatggggggatctaattatactatggtaagaggtctctgtacttaaaaatgttggcccagagaatgctgatgataaatcaaagtcaacatggaggaaaatgcctgcagtaaaatataattatccaggtggacctctcctgtccagcgtttctaataagatgtgaacagagacagaagtcatgcctatcacccaacaaagttagtcaaaaagtcatatggggaagaaacaggtgaaatgtaaatcatttgtacgaattgactaacgaggattattatattttaataccaggcagtgcaaaactaaacaatggagacagttctgtatggccccaagaaaaggcgaattaataaaaaaagaaaatgtctagaaacagatccaaatgagaacttcatgtatgatatagtggcatttctaggcaccacggcaaaggatgggtagattgcttaataaacatggcagggacagataattgagaaaaaaataaatagaggaacccctatctcacagtatataccaaaataaactccagatggataacagagttaagtgtcaaaacatgaaaccatgaaagactaaaaggggatggagtgaatgtgatcttggcaggggaaagacagttctaagcttaacaaagcagaagaaggccaggtgcagtggctcacacctgtaatcccagcaccttgagaggcccaggcaggtggattgcttgagccaaggagttcgagaccagcctgaacaacatggtgaaaccccatcgctacaaaaaaaacacaaaaattagccaggtatcatggcacgcgcctatagtcctggctattcaggaggctgaggtggaaggattacttgattccagaaggccgaggctacagcgagccatgatcacaccactgcactccagactgggtgacagagcaacaccctgtctcaataaataaataaacaaacaaaggagaaggaagcaaaaatgagaagttttcgccatgtaaaatttcgaaactttggaatctcaaaacataccataaacagcaaaagataatgataaactgggggaaaggtagacagtaacacaaatacataaatacatgtttaacacctttgatagagaaagagctattttaatttgtttatattatccatctatgaacgtttaatttataacagtgaaaaactggaaacaagccgactatcaaacgcccagtaactaaattgcagcaccttcataccacggggtgtttggtgcagctatcaaaaatcatgttgtagaaaacatctagtgacatccaaaaaaggtcacacattgtaaagctttttagaagccagttacaagatacacacagtatcatttcaattctacgaaataataatatcacatctgtacagaagaggccaaaatgacatataccaaaatgtttaaaatttaaagcatcttggtagtgaaattagggatgattttttgtgtgtgtgtctctgcatttccaaaattttttttacatacaataaacatgaagcacttttgaactcaaaattaataaaaataattaagtggaaatatatatgtgtgtatataaagacgatcaccttactgttacattttcagatattataaacttgagagggcagccagctagcccactgagtcaatggaataaacacgatgaagaaaaacagcaataaatgtcaagttccttccccaggttgaggggacaaggaggcctggtttaactgtcagttccatgagggcttgagatggctgcttaataaaagactagaacattaatgacttggtgtctatatcaaggaaagggacagactccctgtgatccacacgagtgaggcctcgccaaaagaccacgtcccatcaaaggcatcatcattcaagggacctgtcaacaagcaaataagtcaaaagcagggggcaaggatggtaaggggtttggaaaccatataaagaatagtcacaagtgcttgagatttgcattcaggaggatggggacggtacatacacatgaagacaagagacaagaaaaggagggacaattagctaaactgcttatggcatcttcatacaataatactacgcagctattaaaaattatgatggaaaaaatagtgacattcaaaaaatcaaatattgcaaagttttaaaaagtcacaaaaaccagtatcctttaaacacttacaaaatcatcatatcacaaggaagatgtctcttctagaagaggaacaggacaaaagtatctctacccctgcaggtaactaggcagccagtaactcaacataaaggatgggctttatgataattaaaggtggccctggactcctttgtataaagaaatggaaatgttcagagaatctctatgacctttgtttaaaggtagttctttttttttttttttttttaaatggagccttgctctgtctcccaggctggagcgcagtggtgaaatctcggctcactgcaagctctgcctcccgcgttcacaccattctcctgcctcagcctcctgagtagctgggattacaggcacccgccaccatgcccagctaatttttttgtatttttagtagaaatggggtttcactgtgttagccaggatggtctcgatctcctgacctcatgatcttcctgcctcggcctcccaaagtgctgggattacaggcgtgagccaccgcacccggcctgtttagaggtatttctatacgatgttcctttgctgggttcagtgtgttccctaaatgcgggtagatgtgcctggaggttgttaaaaacacagattctgtgcatttccctaatccaggctcacaggatcagtctctcaggcaggacctcagctcagattctgtactttttttttttttagagacagggtctcactctgttgcccaggctggagtgtgcagaggtatagtcacagctcactgcagcctggaactcccaggctcaagcgattctcccacctcagcctcccaagtagctaggactacaggcgtgcaccaccacacctggctaatttttgtatttttttgtagagatgggggtttcaccatgctacgcaggctgttcttgaactcctgagctcaagtgatctatctgccttggcctcccaaagtgctgcgactacaggtgtgagccagtgtgcccagcatattttgtacttcaaagggttctctcactgattctgacgcacagctaggtttaagaatccttgagccaggtggtatctttatttttaagaaagatctgttttgtttttttttaaggcagtacagaaagaaatgtataaatcatcacattctatcactaatgtgaacattttttaccaatatccatcttgatatctcctgtctatctatctaaaatatacctccaattttacataaacgcaatgatctgtatatgtaacatttttatactatgttgagagaggccgtctttccaactaaaacatgtatatgcaccatcttttttttttttttttttttttttttttttttgagacagagttcttcactctgttgccagggctggagtgcagtggcacgatctcagctcactgcaacctctacctcccaggttcaagcgattctcctgcctcagcctcccaagaacctgggattacaggcacccggtactatgcccagctaattttttgtatttttagtagagacggggtttcactatgttgaccaggctggtctcaaactcctgaccttgtgattcacccgccttggcctctcaaagtgctgggattacaggcatgagctactgcgcccggtccctgcatcaccatttttaatacctgcactgtaagccacaagaacatgctgtaattatcttaactagtccaactgaagaatttgccaacttaaaaaaaaataaccaaaataaacaatgttgtgaagaagagcatctcatacatatcaacacccagaagtcactgggcctcagcacagaattagcccactttacactgtgatagctatcagtggaaaaattaaactaatacacacagccaccaacagggtacatgagcccctggattccattatgattaggaatataatcaacttaaagaaacacaccaaccaggtgcagtggctcatgcctgtaatccaagcactttgggaggccaaggcggtggatcacctgaggtcagaagttcgagaccagcctggccaacatggcgaaaccccgtctctactaaaaatacaagaaaaaaaaaaattatctggacttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggacgattgcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctaggcattcattcacttaaggacggagctcatttctgaattacagaccctgctctccctctcccgccacaccctacatcatgcttagagagctggagggtaaccgggtggtgtcatcaacgaagcttctaggagatgcagcttctaggaacttggacaagtgcttcacagaaatgtgatcgtggttacttccttcctagaccccatggcgaaaaatgcttgcggctttcctgttcttcaaagggcatcagacacgactatcgctcagcatgaaggagatacatagggctaagtgggaagacggcgcaatgcaaaagggcagaggactgaacggggatttgggatgcttgggtgctagccaagaaagactccagaaaacaatcagagggaatctcactttcatttggctttggggctattcttattctctgatgaaagcaccttaacagtacggtgagaagcatgatggagacagttggcgtggcctcgccttcccccaatgcttcgtgcagcaaatgatcactgcatgtacagaaggggatcgaggagtctggagagaaaggacggggcagagagaaaagggggcagtgcctggctcggcgcccagcgtgctgcatgctggtttcaggccccaggaagctggcgggggccttgtcctgagccaggaggagacaggccttggccggtttcctagcaaccctcaccggcagcaggcagtaccccaggcaaggctgtccagggaaaaatgaaaatggccacacgcacagatgcaaaacgaaagcaggcctgcctcccagccgggtgcggaggcaccaggggcccctgccagacagctcccacaccaaactccttggagaaacatctgggggcaccagccatggagggggtctcacttccttctcagccctgcagcacggtaggcacgccgtgaagcccacactctgccactgagtcaccgaaacagcagaccttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcctaaccatccccgcattaggacggtgaggcccccctgtcccagacaaacaaccttccctttggcctctgtcacttgttagttctctatcagctgaagttcatctcatcctattccacccattatgccagtgtcaagagggaggtgtggcaatgaagaggacaaatccttacctctagcacagacagaaagggccaccatcaaggatggctttagcgtcacagaaagaaatccacctgcttgtcaccctcaacccagggaccatggtgacagccagtaccacacgaacctgagtgtggccaaacctacctacagccttatggaacgaccgtcactcccagcgctctcttcgtacctggctttcttcctttgaaattgccttgtgtgatcaaaaatgaatcataaaacatttgtttcagattgttacatgctgtacagtttttagaacaggatattctattttaggatatctaatcctaaaaactctgggaggcaaacaccttcactttacagctgacgttacagggtctgaggctgatacctgtcagggctggggacagagcagactctccccagcctgcttcctgctctgtccataccaggctcctcagattagagcactaagtccatatatggtaaagctgctagaaggactcgacgaaatgattagtatctaaggcactatactatacatgaaaattacagcaagtatatccacacatacacacacatcagagtatatgtgtatatttttaggtatatgtgtatctatgtatatgttgtgtacataaatagaagctggcatctatctgtctacaacaagaatagaagatatgaacatagggctgggtgcgttggctcatgcctgtaatcctagcactttgggagaccaaggtgggaggatcgatcgctcgagcccaggagtttaacaccagcctgggcaacatggcgaaagcccatctctacaaatgatacaaaaagttagctgggcggggtggtgcatgcctatagttccagctactcgggaggcagaggtgggaggatctgtagagcctaggaggcagaggctgcagtgagctgtgatcacaccactgcactccagcctgggcgacagagtgagacctgtctcagaccagaaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggtagtagatgaagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcactcaagttcagcagtcaaaatgctataaaacacactgttctttcttcttgttatttatttattaacatcaaggagaggctcacattttgtctttcagagttggttgcaataggttagacctctttgaagccacataaaacaattcactttgtattatgtaactaaaacttaaacgactttagatttgatgacgctatactgctatccctccttgttccctgcaacccagctccctctgttaaacagggcagctctggggcaacaccgcaggcccttcctaggaatagttcaagaaaacagcctctgatttcctacaaggacggtcactgactgtaaaactacaagaggaggtaagaaagtactacagcccaagggttcctcaacccaggctcctgttatacacctgcctttgtgtccacagtgaaaacaacatggaaggaactggttatgggttttgacataagttgtttcaagccagcagatgggatgagatgctgcttccatgacaaagtcaccctggatattctcaggccgaatgagggtgagatggtaccaggcccacagagaggccgcggctgggtgcgcagaactacgacaccagccctaagaagccaacaggctgttgaatgccaagcctgaactattaatttgcatatgacatcaattctgctgtcagtgtgttaatgtgtgattaattctgtcatgggttagagcaaggagaattagttaattgtcagaaacccttctcgttcactctcgtttagcccccgcctccctttaacttccttttttctcttcttattaaactaacctcctgggttttcttcctctgggcacttctgtcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgcggtcaactgccaatgccagtgatacctggatacattgtacaatctgtgctttgtgtgctgtgcaaataacctgtggggctggagcaagctggaatgtggagttaacacaaagccattgctgtgctatcgaaatcggtcgtgaggctgcccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagttcaacacaaagaaccttgaggtccctaactctggaaagggcaagagaattctagaggcccctgaatgccaggaaatttcaggaggtacaggcatgtcacaggtcaggctaaatggtccccaaccaccgcagcaatgctgcatacgcacgctgtggggtcaaggacaggtgatcctgatggtcacatttcccaggtttgctaacaggcagcccatacctgtgtccacttaaccccgtcccgtgtctttcccttatcttgagttgcctttcactttgaagcaatgaggaaaaaggaatgaatgaaagcaaatggacccgcacaatcatctacaatagtccagaatttgtctaatttatagggctgggaaaccaagtgtcaccttcgggcctactccttccctgaccaaactgcccagaggggctggaacgggcaccagccaagggtgggcagtgaccatagcttttacgtcctcttgaagacaggaggaaaatgcaaagaggcacagactgctactcccctgtcccccactactcattatataacacatgtcagtttcttgaaagggccctatatttgtgcacgaaagcatgttcccaagagttaacttataattattacaatagagaggaagcaggtaactgagacctattttcacgttacaaacaaaattctgtgatctatttaaaaagcacaggcctccctttttatcttggaagtcactgtttcttttaatttggaaacacatctatcaactgaaacctttaaaaacttaacaaggaataatgttgttatgggtcatgattattctaatgtcttatcattttattttgcatatgcccttatagctaaactcaaactagatgctagaatataattgcccatagtaaccaactaaacagttcccctaagcaatgtgtatttttgcgtctctgtctctctcacactctcactctatcctgcccgcccactcgctccccttcccaagtaacaaaagccagataaatccatggaagaggtgaaagagctacagcgactccactttccaaacacttgtgtgtattacaactctttaaaaatgaattacagaatccactttgaaaaacatattcgggcccttgtggaagttaccagtcctttctcaaatgagctggaagtgtctctgatcaacatgaattggggttccttcttccttttcggagtatggatactaattgttttaatatgggcattattcgcacatgaaactagaattgctcagcacgtgggagataggtcccgaccacccatgggcatcaaagatcccatgacatttctgtaaatcagccaaattccaacacagacagcaggcccagcagttgctgtattcagatgaggggcgattacatgctcctgcctctcctacacaaagcagagaccaatgtttctactcctggcccgttctctgggtctatcctggccaacctcctctgggcacagcccatcagacctccagatggctagttctctctagaccactgacatcctacacacaaaggattaccaagaagccagctcccccaggtttacgaaatttataggaaagtctccaatcaagaggtcaggagacagagaacagggtgttaggaaccatgagctggaggagagtcccagcataggggcttctcagctgttctcacttgaaattacctctaaaaatctatttccatatttcttccctggaatttcacttttagaatttgaacattcagaaccttcaggtctccactccttcttcacttggtcagagaatttcacttggtcagtttcacttggtcagacattggttaaaataaaataatttccatttttaaacagtagtaaaaaatttttatttaaatttgtttagacccacaccaatgagtcttctccctgtgtcacagtaatccttcctccttgtcttccttctctctcaatttctcaatacccatcgagtctttccttaacaatcctcccgattcattctcccgctgggatggccaagttcttctgagggcaacacctgctccaggccgtgcccccttggcctcctgatttgccttggaatctggaataagtcagttcttctccaggtgcaggtgatgggggaagtgacatcacacctcacaaaaggaggatttgggggaacgttcagccaccgatgccctcaataaaaatatctcgtgacttggactcaaaggcagtggccttcccagcggcccgcgaggggctgggaggttcccagcatggcactggggctggcagcaggccctccgcacagccccccgcccctccggagccgcccgggggagctgcagcagcctctctgcgccaggcacactcccagcattgtgctccctccagcgcgctctcccccaccaaaaaccctgaggcctccggagtgtacactaaccacaagcctttgagtggctcatgtatttacaaactgaggcatgtcgaaatcaaaggggataccacatgacataattcgcattaaaatgtcaacaggctgacaatttatagagtcaatccacggaaggtggggaggactaagactcagtaattgtttaattcctgctgaaacccacggccactgtgcctttggaagctgggatgcgccagaggcctccaggctgcacagtgccccctggggctggcaccgtgccaaggccaggcaacgggtttaaccatttagggtgctcaatgatgtggaggatggggggaggggagggggaggggagagagggagggggaggggagagagggagggggaggggagagagggagggggaggggagagagggagggggaggggagcgagggggagcgaaggggagcgagggggagcgagagaggaaagggcttaaggggaagatggaaagagcgggtaggaggtaggagaacaggtctttccacaatgtgtgcccaattgacaaaatggcttgggttggtcccaaagagggaaagttgctgttgtacccctgatattccctttgctgtccatgcatccaggactggagatttgaatacatgcaaaagcgcccccaccacaacccctcggcccaagtcttggtttcctggctgttctctggcagcacccggctcaccaaggcaccctaaggaggggtcagcggtgtttatgataggcccccaaactctaggcccaagctccacagataagcaagaaccaagtcatgacccaaaccagatgcctgttcatataagattacccctggaagactctttgatctcttttacctccctcaccagtagcactgttctgatccacgtaagataaaatacaaattcttaggccagatatagtggctcaggcctgtaatcccagtagggaggatggcttgaggtcatgagttcaagaccaacctgggcaacacagcaagaccccatctctaccataaaataaaaagtttagctgggtgtggtggtatgtgcctgtagtcccagctgctcaggaggctgaggcaggaggatggcctgagcccaggaggttgaggctgcagtgagctaaaattgcaccactgcactccaggctggacaacagaatgaggcttggctgggtgcgggagctcatgcctataaccccagcactttgggaggccaaggtgggcagatcactaaaagtcaggagttcaagaacagtcaggccaacagggagacactccatctctactgaaaatacaaaaatcagctgggtgtggtggcacacacctgtaatcccagctactcaggaggctgaggcagaaaaatttcttgaacctgggaagtggaggttgcagtgagccgagatggcgccactgcactccagcctgggcgacagagccgccagaccctgtctaaaaaaaaaaaaaaaaaagagtgaggtaaaaaatcaaattcttactgcttaactccacctggatttttgatattggttctacctatatgttaaattaactgacccttgcttggggagaggtccacccgggggtgagggactggtgaaagggatgcaaaagctaagtttgaaaaagctctgggggtgaagtgtttgatcagctccctcaaatgcaccccaagctctaagccaagtttaatcttttcatcattacatgagaacgatatgtctagagaacacaaatggtagaaataagactatttggcaaagcttacaggtcatcatcaggatctgcattcctcagccaggaaaaactgtgttctgaaaggtggcctcgccctgtggctcttgccccagaggatgcctggggccacgcgggctgcgacagggccctccacgcaagctggctgtacataaacagtaacacctcattctctcttctacctcattaaccgaaacacattaaaacaagtgtgcactgggagcagaaaatgagactgttaaaccaagctgacataatcctcatcagctgtgggaaaggagaccgcatcaattatgctgaaccgaatgcagtcacatggatgtgctgggctcccagccccccagcatgaaaaggaggacaagaggaaaagaaacgttcacttaaaaaagaaaacaggctgggcgcggtggctcacgcctgtaatcccagcactttgggaggccgaagtgggcggatcactggaggtcaggagttcaacaccagcctggccaacatggtgaaactccgtctccactgaaattacaaaaattagccaggcgtggtggcgggcgcctgtaatcccagctacttgggaggctgaggcaggagaatcacttgaacacgggaggtggaggttgcagtgagctgagatcttgccactgtactccagcttgtgtgacaagagtgaaactcagtctcaatagataaataaataaaataaaataaaataatatacttcatactctcctaacaaacacagcttctcgcccatttttgtcaccccaagggaggggagcggcatctgatcaaaacacccctttatggttcttctgcacctaaaaatctttgccaaactatttggaattggaggggaaaaaagaaaaataaacataagcttaaaaaaaaaagaggacgggcgataaggagataatggattctgtgtgatctcttgcagacagattttataagtgcaaagtatctcgaggcccaaagtcctaagacccgaaatgatctgaacacaacccgcttgtgacataatggcaaggatgcttcagaaattaaagggctatggagcagacaatagcaattgaaagctacacagctataaaacacagccagcacttagctctttcagccactgccaatagtgaataacagatcagaactgatacatttagaaatactcataaaacctactacggaagaaaacaaaaataatgcctgtacattgccaaaataaggaagattacggttctggtaagaataaatgaccaaatcattacctacacgtaagaaatgcaaaagacttgtatatgacagtcataaaatgtaaaatgtggtacaaggtgccatcactgagccgtaccccacatcctggacgttacaatatcatatttgatagtaataactaactcacgtgaaatgagtattgctatgcaaaactttcttttgcatttcttcatttgtgttcaaatttgcaaccttaacatgtttattgccactgatttgcatttcatttcataggtgaaagtttccaaacataagctgtggacttatttcttatacacctcttgacaccagcatgaaacgtatgttgccaaaactcagtcctcctagtacccattcaattcaccattcacattacaaagagctgctctgtttttcaagtatactttccagatccacttatgcatctaatcatcaggcaggtcatgagcttggtgagattttgtttctgttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacacacacacacactcttcagctttcaaaagaggtcgggggaagggagaaaacaatcatgacttcagtagccaaggagattaacttccaacgtaccgacagggaagaggagggatgcaccatttaaaaaaaaaaaaaaaaaagtttcagctggagaaaaattttggaatattttaaattaatgggtaacaaagggttgccatggaaacagttttgcatacttgactgcaggtgctccctacagtgaagggagattgggatgatacagccacaagcaaggacactgatgtgaacattaaagtgagattcctaaggcaatgttaagtcatccgagccacggacactgtggttttcgatacaaatgaactcacttatgcaacgagggtatgtgagctttgcaacaccagctaacactcacttgcgtccagaagctgttcccccttttacgatattctgtggtattgccaaggttacaaaatgtaaacagatacaaacacgaaccataacaagaaccaaagtcaaatatattctcgtttttccatctttgtcctctaagctgtgtatttctagattgtggctttatttttttagagtgaatatgcactagctttaatcagaaaaatatacatgtaagggaatgaaaactaccaaggagtatagttcccctgagtgtcctgtgtactctatgccagtttccaagcctacgttctaacttgcatctaattttggtcacataagggaaatacatgtgtgttgatgcttgcaggaagtcctatttaaaaagaaacaaacaaatactgaaacctcccaggttatgtgggacaatatgataaaattatgtcagtgaaggtaacatcatttccttctcacaacggatgatgtcttaggtacttctcagggaaggggtggagcaagccatagccacaatgcagctggacttgaatcactttctaattttcctgagtacttcactagatcactttttgctccattacttaggagaggagatggagatatccctttgggaaaaaaaaaaagtcctacaaacacacacttagtgcttgaaggagacttagtgaggaatccaagctccacctccttcagatgaggccactacagattggccaaggttaaattactggctcaaggtcatttcactaaacatcggtcataatctctcttcagggaaattccatctccctgctccgcaccaaaaaaaaaaaaaaaaaaaaaatccactgacctttccattctccaaaccaacagcgtgtcaagttcaaagctaattaaaaccaaattataaaaataacgtcagttgtgtggtctaagaagacgatgggaaatctaatgcagaaaagcagagtccttaacacctttctgatgctatatgcagactgcgtctaggtgcatttcatgtattatctcatttaagtcattcgagagtcctatcaaagcaagtcattctattagcccattttacagatgatgaacaaacaggaattaagtcccaggagctgggattcaaacccaggcagcctgacaccaggcatcttctccctccttaaaaccccaagagctatctgggtttcctttaagacgcatggacatcctatcttaaatttttctagtctgcagcacccactgagccccactccacctgccacaccaacatgtgcccggcatctcgtgggcatccagacacctcctgaatggtcagatcccattagatttccatggcctctcccgcagtagcttgagcgctcttaaccaggtatgttactacctctagtgaaatgtatgccctcgtctgcaaaaacagaaataaccaatctgagccctgtcttcagagacacaacagatcatcattactactctcccagaggagtaggaaggtggaggggaggacagcagggattgagaagagacctcgaagcttctacacagtggagccgagagaggagagaacatttcaccattaggttttagtattttaccctcacattgcattatgaacatctccaaccaaggagatgagttgaaaaaaaaatcatacagtagacacttaagtatccaccacccagctgctgaaattaatgctttgctgtctattttacagccttctctttatcctgctatcaatgtgccttacatcttttattcattccaaagtaaactgcagaagcagtacactccacccctccccctactccagcatgcacagcctcaactacagttttctttttgtttatgggtttttattgtagttttattattttaatagatcacgtgagcagacttcctgactagcaaaacactaaaaagacccaaactccagtgtgttgttattatgaaatgtttagctcacaactttctttttttttttttttttttttttgagacagagtctcgctctgtcgcccaggctgtagtgcagtgtcgcgatctcggctcactgcaagctctgcctcccgggttcatgccattctcccacctcagcctcccgagtagctgggactgcaggtgccctccaccacgcccagctaattttttgtatttttagtagagatggggtttcaccgtgttagccaggatggcctccatctcctgacctggtgatccacctatctcagcctcccaaagtgctaggattacagaggttagccaccacgcccggccacagctttcttttaaaagttagagtaggctaggcgtgatggctcagcctgtaattccaatactttaggaggctgaggcaggaggatcacttgaggtcaggagttcgagaccagcctggccaacatggtaaaaccccgtgtctgttaaaaatacaaaaaaagttagccgggcctggtggcgggcgcctgtaatcccagctacttgggaggctgaggcaggagaatcacttgaacccgggaggcgaagcttgcactgagctgagatcacaccattgcattcctgcctgggtgacaaggcgagactctctcaaaaaaataaaacagagtagtatccacaagtatgtgagaagaagttccagttattaaaattattttagtaccatagccacaggttcagtaagtacaagaatgaatctgcctttgtcctctgtctagttcacctttctatatgattctaccctctttaaatcttgctcaaactccagcttgcccctccctcccagaggtctttttggatctaaccagttgggtgtggctgctccctcccttcaccttcataactcttgtgtccgcatttgacggctcttactgaatgatcaattcctctttgtattacgtatcacagtaatacagtttcttaaactgtggatcatgacccattagtgcagtggttctcaaactgcagccgcacatcagaatccgacagtaaatgaaaccacaacctctgggggtcaagccaggcaggcgtagttttttaaaggcccctgggctaagagtcgctggattacgaaatcaggatcatgtcaggggatcatgaaatccatgctgtgagtacaaccagcatttgtaaaacaaaacagaattgaatgtaatagaaagcatcagaatgtagcacctgcagtaaggataaaatcattctgcacaatttctgttttagtcaaatatacagaatatctagctatatgtatgtgctgggtcactcatgtaaaatgcatttctttttagattatcgtcaacaaagtttaaaagtcactgccctaaagaagcaaggacgttatcctgcgcatagcgggtgctcaaggacgtgtggcttgtacatgggacaggaggagagaagcaggtcagagcttctctcactgggaatatgttctgccaccaaaaatgtggttctcagggcgggggacaatcagatatgggactaagtaagcatcattcagacaaagacgctcgcccaaggataagggaacgaaagcaggagaggagcctctagggaaactgagggaggaggcgactcggggctgcccctaatctttaaatttctatgtttaagattccgtcttttggccgggtgcggtagctcacacctgtaatcccagcattttgggaggcagaggcaggcggatcgcccgaggtcaggagttcgagaccagactgggcaacttggtgaaaccccatcactactaaaaatacaaacattagctgggcatggtggcatgtgcctgtagtcccagctactcggaaggctgagaatcgcttgaactcgggaggggggggttgcagtgagctgagatcacgccactgcactccagcctgggcgacagagtgacactctgtcttaaaaaaaaaaaaaaaatccatcttttgccatcaaatcatcaggcgacacttgctgatagtctacctaatatccccaagaccctgggaaggctacaaagttgggtgagaataaacagatcccaccggtaaggatcttacaactaagcagagaagaaagaccactaaaaatatggtctatcataagaatgggaaaggaacaaggcattttgatgagagtgctggggagaaagagcagtgattttagttggcagaatttgggcggacagagccgaaactcacgggtggccagcagcacgtgggaattttcaaagtaatttgacaccagctgcatgatcttgccagggctgtgtctcaggggtcagtacaggaacagagctgtgtgtgaagctgatggtaaatgacctgggctgcagaagctctgcaatgacctggtccacacaagccatccactttacaccaacatatgccttagggctctaccttatgaaatgccaagtgtgcgcatgaggctgttgtacctgttctagcacagggcagaagcacggcatgctctgctggtaccctatggttcaatatttattgagctggtgtcacacactgttctaagcattagggacagagctgttaatggggcaacgtaggtctctgctgtcttggcagacaactaaattaatgaacagacaagaaaaataaatataatcactgtcaatgcagagaagttatcttgagtgaagtgatggtgtagctccttgagactgggttgtcagggaaagcctctttgacgaccagatattgaatgagagctgaatgtcaaggtcaaggaggtacatacactcagtagaacagcaagtgcaaaggccctgtggcaggcgccagcttagcatgttgaatgaacagagaaggctgctgtggctgcagtgtagggggcaaaggggagagggttgtaaaatgaggtcagcatggtgggaggagttcagatcacaaaggagcttgtaagccacagtacaaaggtgagcttttatcttaagtgaggtggaaagcctttgtggggtctttgcaagagagtgatatgacctgattttcctcttcgtaaaatccctgtatggagaggggattgtaaagggcaagagtagaggcgggggagagttgaaatacagagagacgatgggggctggcctgggagggtggtggtgcaaatgtatttttgaaggaagcacccacagaacttgctgatggtttggctgtaggggagcaaaagacaaggagccccacagatagttcccagctttttgggttaagcaaatgatatgctggaggtggccctaaccgagatgggggagcccataagcatttgggggttctggtcacagagtcctttctgcaccatgctaagcctgcggagttcattctcagacattcgaatgcaaatgccaggtggggagctggatacaggaagaggcctaggctagggacagattcagatgtcatcagaaagtagatggggtttaaaaccactggactgaatgagatacttagggagagttacagacagaaaaaagaaggggctctgggacaagcctgggggcataataacactcatcgtgaagtcacagaagagaagccaacagagatagacaaagggcaagagtggcaaaggcggctgaaaggtccggcgaattaggacacagccgacagagtcagcaacacagaaaccactggcgacctgtcctactagtggtgaaaagtgtcacttctggatccagcaactgggaggggacatggtgagtcaactcccagagtgggcatgattcagagtgaggggttgctgggcaatgcggccttgggccttgggtgccagcccccatggaggaccaggtgacttccatgagtacaggctgccagcttcagggccaccgccatgctacaccccgcagctgctcccacgccacctgcagaaggcagtacctttccatcctctctgttccacttctaccactgcagagggaaggaaggaaaacaccatctcctctcacttcctgaccttcctcctctgcctccaagagcctttttttggtttgtttgtcctatgcacgactttttcagttttccaacaatcactggtgtcctatacttcttaaccctccacttgtaaaacaacacctttcagacactcctcagctacttttcttgcaaagaaacttgctgtcagtaaagacaagagagtaaatggagagaaacggataaccacctgctgatgtctacttgtgctgcattcttgagaaactcacaaaactgaaggcaatccaggtcctcaagaggtttacgaaccagttggtgaaaccacctagcacatgacgcagagaccagcgtggtgccaaacagtgtgacacccgtgtggggcagagatgccgtgtgtgggtacagcagctggagagacagttctggaaaaccagggatatgtcactagagcataaaagatggacaggaaatatgctcttccttaaagtctgattaaaaaataaaagatactttccaacagggccccgtgcccatctcagcaacgcagggcgtgtgtaaccaaatcacacagaaatgagcacttaaaatgacatctgttggattaattagctgtgtaattagtctcccctcagcggagctgggctttgtggctgttgtctgaaatctccccaggtgacttgattccaaatgccacactccaagaggaagaaagcacaggccaggaaaagaagacaggcgtccgaatgtgtttgcgggaggcagcgggaagggagagggagtttctggagaatttggtgggtccctcgggaagctagctagaacatcagggaggaatagccatccacagaggtgtcactcgagaactcaccacctcagagcaaatcggcacgcccccaaggcatgagttttggataaccccaaagcactaaacactcagagacatgaattagggcggcaagaccctggaggtgaagagagccgagtatggattccgagttggacacaaagagacgggacagaggtcagagctcttgtccctggaggagttgtttggtcttcctccgctgacagctgcagccatcactaatgtgaacccagtctgggcaaaaaaaaattaataatgaaaatggtcagagcctaatctgagaaccagaaagtgaacaaccacgcacaaacagaagtctccagccaaatcactccccacagtgcttcctcaagcacagctggcttcggagtcacacttgctgactcatgtctaggacacatagccctgggacccgcgccacttggcctggctcactagaggagccgaggaatattccccatgcttctctatctataattattttagaaaacaagagacatggcggtagaggggaagtatagaagacaaaggcacaggagctatgggaggaccacagtgaaaaccatcttggagcaggggactcctcagctggggacgagccagtggggttacctttgatctcccccacccccatctcgaggcacagagtaccctccacagagcaaaaacatccgatgctgctcagagaaccttcctgggcctgcgacaatgagcagttcgtaaagaatctggaacatgaaacattcaaatcaaacaagccctgttcgaaaccagcaagacatgttctaaagctagatggagccactctgctaagacactccctgccataaacacaatcggagctcctcccagatcttcagtagcgccaacaggcatctgcaggaccactgcagtgacacagactcgctcccaagggcaaaaggggtctgggagcaaacaccaaaccccgacattatcattctcattgtcccgaaggcccatagatacaggctgggtgcagtggctcaggcctgtaatcccagcactttgggaggcccaagtgggcggatcacttgaggtcaggagttcgagaccagcctggccaacacggtgaaaccctgtctctactaaaaacacaaaaattagccgggtatggtggcaggcgcctgtaatcccagctacttgggaggctgaggcaggagaatcacttgaacccgggaggcagaggttgtgtgcagtgctgtgatcatggctcactgcagccttgacctcctcggctcaagcaatcctcccaccgcagccctctcatgtagctgggactataagcaccaccacaccctgataatttttttattttttgtagagatgaggtctggctatgttgcccaggctggtcttgaactctcaggctcagctgatcctcccacctcagtccccactgcagctaggaccagaggtgtgtgccgccacacctggctaattttttaaatttttttatagagacagggtctgtttatgttgcccaggctggtcttgaactcccgggctcaagtggttctcctgcctcagcctccctgtgttgagtttacaggtgtgagccatggccccaaacaagttttttagtaacacattacacattcgtgagcctgagtctgtacaaaatcctacttcaatggccagcacaaaatcagtactccacaaatgttgttgacccagggaacgaagaccccttcccagtgatttcagtctcccagaagctgcacagggaaatctgggaaatcctgtgcctcttgggtcctgagggctggggtctgaacccatgggaggagaagaagtcagggtagccaatgcaaggatgccttccacccagaacccagacttctgtctcattctgaggggcagcaggaagacacggatgccccggtgtgacacgtgccaccaagaaaactccacagaggtcagctcagaaggggttagaaaggtccagtcatcctccaggaagagcatactgccagcgacagaagacaggaagagagactcaaaaggaacagcaggtgggtgtaaaccccttcagcaaccccagtgcacaggccggccctgccaaggcaatgtgggtatcactgttgacctaagagactggctatgctttggaggctctcatcctgagtccgggaacatgctccactcattaacaggttacaaaccaaacactatcagtagataaacatttctaaccttctaactagtttgccttttacagaaccaggagggggaccctagagaacatctcctaatcattcttgatgattagtcccaatttaaacctactctctgcattccctattagcgacctatacaccataggcacacagggtctcccacgcactgtgagcaatgctcacgtgctgtgaattttcatggtctacatataagtaaccagtgcaggaggagaccaagaaggcctggagtgaaccaggggcagcttcaacatctggccaagttgctggtgaccgaaccaggcctcctgatgtccactgtgtgacgcaaaggcatttcaataaaagggactcatgaaaaaaatgactgaaaagtaagtttgaacaaacagctctagagaaaatttcagatttctttataggaaagcattttacttaacacacaaaatgtgaatattggataggacacttttctataaataacaaaaactggatatcatcattagaggcatttgtaaatttcttttgttgggaaccactggaagaaaacgggtttcacaaacaaggaagccacatagctctctttacacttctatagagcctgctggcaggtcattatgaacaaatttctaggctatccagaggtagagctgctaaacaaaacacgggatgcccagttaaatgtgaatttcaggtaagtgtaagtataatttatgagatacacttacacaaaacatcattgttgcttatctgaaatttacgtttggaggccaaggtaggaggaccacttgagcccaggagtttgagaccagcctgggcaacatagtgagaccctgtttctatttttttttaatgtcatataaatttctttttatacaaagaaaaagaatgaaattcacatcactgagaattccacagttttctttgctgtatttgccaacaccatcccaagtcaccaccctaatgttgctagtttctacagtcgccagtatttctatgagtgacagattttctgccattagaaaattttaactttcattctacatcccggctgctgtaagtgctaaaaatcaatttctgttaagtattaaatatatacttactcaatactaccgaaatggttttcatagtaacagcctttcccaccctacacttactagtatttacagtttcaactgatgtgtaaaacagaataaagtacatggttcaggtggatcatataattatttaaaaactcttgccttttcctgactatgttcctgacaatgcctaattgttcccttatgatttccctttcaaaacaaaaaaaccagaaacacctgttgggactagacgtattcaaatctgccctttgagtccaagtcctcagcaagttgaaagaattcaacattgagttcacacctttgccccattatgtggcacctgccatattggctttcctgccagagtgtgtttacctaaaacaaccgtaacacaacgcattatcctggaatgcagaagcaacggaatatttgcacaaaattctcctaagggttacagaccacccctaagacggcagatgtcatttatgcgaagaattccacggtgtgacttattcctctggatgggtggggggtaggtgaaggtactggaagtttgaggtttctctctcataagaaggtccagggctttctaaatagagaatcggggggattcgtaaatattttgacaaagtggtagctattagactttctgaaattagacctccttgctgctcagcctaagtcaggggccatggtatacctttggaatccaaaaggagacttgtaaccagtacctgaaaacagtttatactggaaatatgtcgacagagtcatgaaatttatatgctatttacgtaagaacttcaggaaagggaatttccatggctttcagaatttgttcctgaccccttttttaagataaatggtgagatccacagtctccattaaggtgccctaaaaacccagctcctctttgcagactctgtttcttctggaaactctctcatcctggagagttcaatgaaggcaaactaatctaagaaattttcttttggggaacatgccagagagaaataggaaaaggtgagaggaaggcgtttggtccacagactccaaatgccaggaaagagagccaggcctttccatcccttcttcttgttccccagtgtctccgaagacagtattccgtaaatatgttctgatttacctaaatctgtggatcattcacaagaggttctgcaagacgtaagagaatggagaatgagaaacagcttttcacaccagctaggaaaggctggttatttaagcaatcgttgtacagctagccattgaatttgaaggaaaataaagagtcctaaatcacactgcatagtcttacaactatacaaaaaatatattcctgaaaagtcacaaatagggccaggcgtgggggctcacacctgtaatctcggcactctaggaggccaaggtgggtggatcacccaagttcaggagtttgagaccagcctggccaccatggcaaaaccccatctctactaaaagtacaaaaattagcgggtgtggtagtgggcacctgtaattccagctactcaggagggtgaggcatgagaatcacttgaacccagaggcggaggttgcaatgagctgagatcacgccactgcactccagcctgggtgacagagtgagacccagtctcaaaaaaacagaaaacaaaaacaaaaaactgcatgacaaaaaatgttcccccatctacattagaacaatgaaaagggacttactttagaacaatgttgtcaatctgacaatgaaaatggaaaaacaacaacacggtgttggtcactgtgtgggagtctggccgtcacttactggggaaggatgacatggccacctgctttctgaaaggccactgggaagtgctgcatctactggcattaggtcctgggacccaacaaccccacttcatggtgtgtgtagagaatcatgttcctagctcattatctgcagtatccaaaccctgcacataacctcaaggtacatcaaaaaggagctggttaataaaggaaatactatgtcgacattaaaaagagtatctacatgtactgacctaaaatgattttcataaaaagtatctatatgtactgacctaaaagtatctatatctactgacctaaaagattttcctgaataaaacaaactgacactttgggaggccgaggtgggtggatcgtgcttgagcccaggggttcaagaccagcctaggcaaaatgtcgaaatcctgtctctatgaagaatacaaaaaattagctgggtgtggtggtgtgcacctgtggtcccagcaacttgggaggctgaggtgggagaatcacttgagcctgggaggcagacgttgcagccagccgagatcacgccactgcactcccatgtgagcgacagagtgagaccctgtctcaaaaaacaaaataaagcaaaattgaaaccacagcatgtgtctataaagatttttaaaaatgaacagtatgtgtgtgtgtacagatacatacacacatgcattttcatctacagaagcacagaaaagagcacaaaatatcaactacatgtaacagtgggtttgcctctggacagtaaagtcagaaagtagacaaaagacatccactttaaaaatcattggaaaatacttaaagatgtaaaaaaggtctcaggtattacacaacgtcattccaattttgtaaaattcctatgttacatgcaaaaataaaaatccatcacatggtaggattaaccagatatatttactttcttttttattcctggatttttccaaatttttttacagtgaacatgcattactcatattactttaactgtaaaaaatagggaatccacattttattactagcttacacttgaggtaaacatggaatgctaaccttttaagaaataattaagaatacaatactattctaaaagggtctggtcagttctttactatccacaaaaaggactcagaaaagagagagagaaaaaaaacactaaaagcatttagaaaaaagagaataaaagtgctatggttaatggttgcaaaactggtttttcaacaggtggtttttaagtactaaacttttttttttcaataggcacaactaataagatttcagttccattatgtggtgtctaaagagtggagtgaaaagatatcactgacctgatcttcttgacatgagggtgtgtaaaatgctctaaccagagtgacccacacaaagcttgtgcctaaagccatcggctgagagtgtgaaatacaacctattggacgaatgtggatgaagataggtgggaagcttctggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaaccatcaagccacggaaatgaaccgcaggcctccagctgctccaggagaaggagggcatgcaggcgaaatctgctaaaattcaccaaaacatctggccttgcacaccttctaaatcacctgcaggaaaacattcctttcctttcattttttggttgaaggcatcaaggtagggagagaaggtggcagaagtatgtacttaaaacaaacaaaaaaaatagtctaataatgagaaaacaaggtttgaggcaactggctccagaatcccgacgcaaaccatatgacactttcaccggagcttcaaacacacagccaagctgggaaggcaggacgggagggaggaaggggacggtccccaaaggatgtatgctttttgctctcagtgcaagacaaaggcctccaggcaccacctacggacgtaaaatgtgtagctatcttcctaagacccccacttccccccagcacacccacagaggagcaccaagaatgcagatttcaaaccagatcattgtctgacttcacctacattttctgatttgcccgtctaccatacgatgattttatagccctgctgggagtgtgaatcccaatgagtttcttatgcatcagggaaagaactgaaaagatgggttctaaagcaatgcaaagtctgatggaagttttcttacattcttccgtactgcacaatcctcctagaatggcaggagcagacatcctctatgtggagaatctggccatgtgcatgaatcaataccacactctgcctcctacctcaggccaagcagagttggcttggacactggcttctcctctcctgtgtgccctgttggcccacagcagctcacatgtggcccagactcaacaccgtggtagacaaccctccttgtacagtatttaagattaacaggtaaccttcagtcttggtccaatcaaaggaaccccagctagaaaccgttttgagtaacagattctggtagggtcttaatctatctgctaaagttgacagatttccactccaatgactctcaggtgaagaaaaacatcaaagtgaaaaacagattctgggagatggtgggagtgtgcactgatttccaactgccctttctgtgccccgccccctccgggtagaaagcagcacacatttcagagagctcaccatggacgtcacttggctgggaatgcaagataaacgtggaagagctggtgccagctctgaacccacacgcctcagacgcaggctgtacactagccgtgggagagggcagagggcaagcatgtgtcagtgacagccgctctcctagttctgaggatcaagggcacccacatctctacgggtggagaagattgagagtggggccagggtgtagtcctctgagaaaggagtgatacatttacatgtgaaagcagaaggatgaggaattaaggaccccggagctcagtcccagttgagagacaagtgccttctgcatttttccatgctggctcagatgtgacactaaggacagaaagagcccagttcccaagcttcactggagcctctgggcttcttgctatgtcagccaatcacggggatcccaagacggtaaatgttaggacgtggacatgtgagcattaggggctaggccagagccggccactgtttcaacccaaaagatcccaaggatttcaatcaggagcactttgcagaagtaacctgaggcccagagacaaggtaagggggcttcccccggatgcctcgggccctgcggcattcccctactccactctacttccaggaggtgcaaaagaaaaacaggttgaacctaatcctgatttaaacattagtatcacacaaaaatcaaaacgacaccattccaggcaacgaagacaatatcatcaggttttgtagattagcacaaccctctctcatttctggattaaaaattatctcacgctttcagaaagttcactcttacagcaatctacgcactagcatgcgtgacagcaagggcagtgactccggcccagggtgaggtcagatgacacaccgaaagccatgccactgcttgaatctcctgagaatgcagctctgtctcctccaacatgaaaaaggaacaggaggagaataaaagcctcggctgaaagagaggtctgggagggccaccgggaagccacatacatcactgccacttcactaggtgccgcggagagcagctttggagagccgccctggctgatcatgaataatttgccagggaaccgggacagggtggggtggggaaggggtgaggaaggagggttgtgtgtgagaagcccggtcagctccccgggtcagctgcatctggagcggtttctctagcagacagtaaagaactcgattacatccagttaactgtgctctaaactgattatgcatgtgccgggctaatggattacattagcaagaggaaaaataacatgcaatcaatctccatttactacaggccacaccagggcctagagaaaaagtgactctcaaaccacctccaatccccaccccaaatccgtggaatgacgaaaccttgagagggagccttccttagtggcaagagaagtttgatcttagtcgtactgagggaccaaagggctgagggcgagcactggaatgacaatcccagcggtgtcatccaggagtgagcgggagagctccccgccccctgtggcgaagcccgggcaggcacagggccattcattacccaaggactaatgagactagactaatgacctttggctcctgacggaggcaattctgccctgaacctcaggctggtcactccggggatgtgccggccagatgcaccatttcaggatctctccttcaggtgctgggtccacgttctaccctgcatcccaacgctcaggacccttctacccacgccatctttttgagcaacagtttcctctaccttaaaaaaagaaatgagaaaaaagtcccaggatgacaggccagcagtgcagaaacatgcaaataaacctcgtctcttccaaccacacctcaccctgactctctgggtgtgatccgtggacacagtttggggaccaaaacaggatgttctcagcaaatccgccgagttccaggcccgtaagaagcaaagtcaagtgcctgacagactcttattcaagactccagccgcacggaggatgcagcatgagagttaatcgccaccgtgtgcattttagagtctaaagggcaattttttccttggatgcaagaggccagcttcatgccacctctaaacgaccttcatcaaagttgcatgcaaccttcaatggccacgccgagtcctttgtacaaattttactcagttgggtcctttggaaattcttttttccactggtttttccatcaggttttcttgaccacgtcggcaccatcctgtggccagttcagacctccaatttaaactgactgcaaagggcttttttcttttaatggtggcaaaactaagccagtccagcaaggttcttgctcatttgagataaggggattggatgcgtggtgtccagaccttcctcactgcaccatagctgagtccacagtcagttccagaacattctatcccctctacctcattcctgctttctcctcctttccctaaagtgctttcttaagcactacgttatgcaggcctccccacatcctgagaaggaacaactataaaatgaagtacaattatcaaccccggcagaggccgacatgggcaaaggactagaagtcttccttatatggaatctccgtttaaaatcattctgagtagagtagggactcaactagctcggggccagcagaaaccaaacactcgtgggcccaaagacgcgagaaacagtgtgaaaggcaggaggagaggctgataatgggagtgaggaaaatgaaaagagagagcgagggagtggaaggtgtgtgggatcaggccagggagatttatggcgatttgtacctgattgttcatactaaagccattatgggatgattagagaaaaaggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggagcatccgggaaaggagaaatagaaaaaaaaaaaaaggaataaagagatggaaaaggagaacagaaagcctaaaggagagagggaaaccacaggagcagaggatgcaaaagagcccatgtaagaaagaaaagaaccaaccctagaggcgctgtcaacaaaacctgacccaaaattgggcacccagaaagagaaccttcagctagtcaagctactcactgaacctgtcacgtttccacctggtgacaaagtggacaccgccgactctcctctcaactccaggttcccaaccaacagccaagcaggccatgccagagactgtccgactcctccccagtgctccctaactccccggtgcgcaaccccctcctttcagaaagagcgcctgagccataaggagctgggccttaccttgtacaacttcaggctggcctcgtgcctggagttgaccgtgtgcagccgcagcttctccaggctgttggtgtagtagtcacaggcgttgcacttgaggtgcacggggttgccgatggccacacacttgagcctccactcgttggccttgccgccctccttgatgtgggccaccagctggtacttctgcacgtgcttgtctgtcttgcagtgcagctggaagttggccttgagctgggtgttgtagcggcagagcttgcactggtatgagtcccccatcaccgccttccactcgtcctccgacaggctgcgctccacgttcatgtgcaggcccagcatgtccaggttgtccgtcgtgaacttgttgcagacggcgcactggaagagcttcagcgacgggtcgttggtctggatgaagctctcgcccaggttcatcagctcctctgacaccagctgcccgcccccgagccgcatgtctagggggatctcaccgcccactgcagggaaggagagaaggagagagtcagacaccaggctcatggtcacggccacagctgaggcaccccccagccctccgccaccctcaactggggtccaaaaggagaagatgacatttcaagtgttgcaaagggctactggctggaaaacaagcaaacaaacaaacacagtcaacctgatgtgtttcaatctttcctgcggacattctgagatttctggcaggttttgtattttctttctttaggaaaagaacacctagaaaagttaggagccatagcctctttaatatttccttttctttttttttttcccgagatggagtcttgccctgttgcccaggctagagtgcagtggcacaatctcagctcacggcaacctctgcctcccgggttcaagcgattctcctgcctcagcctcccaagtagctgggattacaggcacccaccaccacggccagctaatttttgtcttttttagtagagacagggtttcatcatgttggtcaggctggtgttgaactcctgacctcagctgatccaactgcctcggccacccaaagtgctagaatgacaggcatgagccaccgcgcccagccacctctttaatatttcaattcatcccttctctgagatccaagaaaagacagaaatatgtatcattcactggatataacagaatctcaaactgcagaccttccaaaattggaaatgagtcacagctgcaatcgtaacataccaagccttcatggggaaccagaattgggcccagaatgtatctgaggtggcagtgaccaacatgactttctgccaccttgagaacaatctatggctgtgtcatctggtgcagcagtcactggctacctgtgactaataaatacctgaaatatgggtagtgcaactacggaactgaattttcaatgttatttaaatttaggaagctacatggtggtgagtggcgcctgggttggatagtgcatctctaaagcaaagatctggggagtggggctggacgtggtgtctcacacccctaatccaagcactttaggaggccaaggcaggcagatcacctgagcttaggagctcaagaccagtctgagcaacatggtgtacaaaatatacaaaagaaactagccaggcatggtggcgtgtgcctgtagttccagtactcagggactgagatggaaggatggcttgagcctgagaggcagaggctgcagtgagctgagaccatgccactcagctcagccctggtgacagagcaggaccctgtctcaaaaacaaaacaaaacaaaaaaagacttggagagtaatccctctactcctcactgctgccctctggtcaatatccctcccgtcagtcaatgctgccaaccctcccatgtcttctcagtagggctacctgttctctttcctgatcctctgccctgggtgacatgtggggctaccctaggaccaatcaccttccctttatcactcagtcacctacctacagagatgcaccatagctgggatccccatcagggcaccacctccctaggacaggggtccagtcttatcctcgctggccctctacagagtgcacagacgcccaaatgtttgctgtgccagacaagagtgaaaaaagagcgggactgctgcacgttcaggaagtggattgagacaggcagtgagacacgaggctcagctccacgtctccacgaaagggccgggcgaagatctcttcctccctctcccaccctggtctttttcagtccatcactgccctgcataaaccgggtacaagctcacatttgctatggtaaattaatactgcaagggcttatttctaccaggagaatggcttaaaaagagcagccttccctccagttcctagaagcgtacggtcaagcagaaggctgggcactggcgtctagtttctctttcctaaacacacgtgcacttgagctattaggtctgccccaccccccaagtgaaatttaaacttgaccttttatgtgtggttgggctgaggttattttattttttacaactgattagaatccaagtcagtggctcatcagagaaaatatttttttcttttttttatgattttcttattgacgctacacaagtcacctcgagtgataagatcagtacaggttctgctaagcagaccagcagctgcgtttgaagctcacggacagtctagcaagccacagaaatcttttgcacatgcattccagaaggcttaggaagctttcggcttgttgtctgtcttcccatctcccctggtgagaggaaccataactatgtcattctttttaggataagaaagaaaaacagaaaggaaaaagaaaaaaaaaaaagcctaaaagctccatcccttaacggggacgaaggccaggcaacatccaggaaacatactcagtgttcagtcaaagcagaaactgcccggagggtaagacaaggagcaaacatatatttgtttctgatgccaaccacctgaagcatcaaatcgtctccactttttagatttcaccccggcacatcaacatcgctctaaagagaaattcagctgtcacttgctgatgcctgagtgaaaatgagaagtccttggaataagcagaggaacgaagtcccagtttccactttaagctctttttttttcaagagacaaggtctcattctgttgcccaggctggagtgggtcactgcagtctgggccaccaaggctcaagtgaaccacctgcctcagcctcccaagtagctgggactacaggtgcaccccactacgtctggctgatcttaaaacaaaaatgttttgtcgagatgttgcccagactggtctcaaactcccaggttcaagtgatccttggactcccacagtgttgggattacaggcatgagccaccatgcctggccagcattctaggctgttaaaatgaaatgcaaaggacagaagcagcagagtgctgaaatgagtgaggatgacaggcaagtgaaaactcccttcgagaactatgcctcagagaaacaagcccagggcttagaatcctacaaatccgctaatccagctgccacaaagtgggggaatctcacccagttcacaaacaggagcagggcccctataaataagaaactggggctgggcatagtggctcacacctgtcatcccagcactttgggaggccaaggtgggcagatcacctgaggtcaggagttcaagaccagcctggccaatgtggtgaaatcctgtctctactgaacacacaaaaattagctaggcatggtggcgcatgcctgtaatcccagctactcggaaggcagaggcagaagaattgcttgaacccgggaggcaggggctgcagtgagccgagactgcgctattgcactccagcctgggcgacaagagtgaaactccatctcaaaaaaaagaaatgaaaaaaagaacttggcaggtccttagtcttgagccacactggatacgtggtcttggagcaggtccccatctctgggtatgcacctaactctaacactggaactgacaccttgacacgtgagcccacccatcagcacatcctcaggaaggtgcatggattcaaaggcacactctggaatgaaagggagacgaagggagctgctaaaccttgtgcaggtgtccaggggctggctggctacttgggaaacacacagccaccccgacaagcaacccctttcttggtgctatgctaaacttcagagtcgaaaggaaggtttgggaggatgttcacaaggcctcaaatctaatgtgctgtctacaaagagcagcagatccgactgtactaggcgaaggagccccaagcctttcctcaaaggcttctgaaaagaagcaaccccacaatcagtgtctgtttgatgatactaaagagggctctgccaagggaagtatgaaaacaatcaccttgtaaagaggagtgtatttcacaaaaacatttttctccctgcagaactcagtcacatctaataacacctacagccatcttataaatggaccatggggaaaaaaaaccagtacagccacagctagaactgaaagttatggctgtttttatttgcataagttggtttctcctactgaggtcatacaactcaaattccaagtcttttggacacttcctatggcccccacacccactcgagcttctggcataaaggatttgtggctctcacaccttctcagcagttttcgcggcccaaggaaggcacaggtttccagggactccccgtggccgacaagtagtgacactggaaattcaagagccctttgtgactgagctggataaatcctttgggaggaagagctccagtctaagaaatatggtgtggcccttccatgtgtgtctacaacacagggcttcattcttctgctccttctgaatctgccgcaatgcccaggacagtgcatgatgccccaaagactcacagacacttggtgtgaaagcgaaatatttctctacttctcaatacaagccttagttacctgttcttaaggtaattaaaaagcctcactttaggctgggcacagtggctcatgcctgtaatcccagcactttgggaggccaaggcgggcagatcacctgaggtcaagggtttgagaccagcctggccaagatggtgaagccccatctctactaaaaacacaaaattagccaggcatggtggcgggtgcctgtaatcccagctacttgggaggctctggcaggagaatcgcttgaacacaggaggtggatgttgcagtgagccgagacggcaccactcactccagcctgggtgacagagcgagactctgtctcaaaaaaaaaaaaaaaaaaaccctcactttgacccaacatgaacctacccacgttcccacgttctgtcttcattccacctccgttatgtttgatttgctccaagatctacctcccgagattctatgactccttctaattcctactggcttaaagaaaaccttagagtactcactcccatctcctggtgtgcatggttcaccctggtgacaaataagacgaccagtgcttgtgcatccacaattagccagttggtttcaaataccctcaaatcatttggtaataaaggatcaacaggcaaatatttcaaaatggaaaatgagattaaagtactaaggattaaaaactgaatacatagcaagaaaaaccaatggaatgctttgaaatataactcatcggcaacaattagcactcaaacaccacacaaataaacacttgccaactgctgaggcctggccctgcagtcatctaagccatcctggaaaaaaagtcctcactgacactctgttgccaagaacaacctattcccatgtcaataatggcatattgcttaattcaggccattgtcactggtcccacgaagtccattagcagcgtcacgggatgggacgcaggcaggatcctgtttgaagcataccgggtggaggcacgagtggcccaactatcagaaggttctcatgaaacccatctgtagattgttttggcagcagcagctatcctcaaagtggctgtggttcgttctacgtaaaaactcaaagtttttagcacccaaatcctacactcttggtcctattctagatattgtaagccaattggtaagactgggagcctgaacagagccaaatcagcttctctaaagcagaggtcattcttcctggcagcgaaggctccgctaaccaggatctaactgctattaaaagttaactttccttgatggacaatttttacaacttactcatttttcatctctcacacccctcacaacagtgccactggggaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacactgtggttccgaattcctattattaagatgattgtctctacttaaatcattgaggtaactgtccctagtcctcttattgaaatgattgcctcagctacagtttcctgtaagtttcagtaaatattcgatgaaaccccaaagttttaggtgattatagtgatttttcaaattgaaagaagagacagagaaagagagaatgggaacagaaaactagaggaaacactcacattttaatcctggccccacgtagccagagtacaagcatatctcttttgaatgcataaactcttccatatgtacacacacagttcaagggattcttgagaatacttgattgtaagacactccagtttacacaaaaaccactcgagaagaccagagtcaactgaatccacaggactatctcaccctattcaccattctccctggttaaactcctatcatgaaaacagacaaacacgtagtcatcctcacctagagcaggcgtcatggcggccatgggcccggcgggatccagctggaatccgctcatcatgaactgggcgtccgaggcagcactgtccatcttcaggttgggcaggttcatgttctgggccaggtagtattggtagagctcggcctcggcgggtgagggcaggctgccgaggcccaggtggcggttgtgttggatctgggtcatgttctgttgcagtaacatcatgttatgcatgtgcttctcactggtcatgtgaatgcggaggttcctggccacgttggtctcataatcacacacctcgcaccgccaggtgggtttggtttttggtttggtcggcgagggggccccgcaggagctactgatattggctgccgccgccgccgcagccaccgccgccgccgccgccccggcagtgtggctgaagacctgctccccccctccattctgcaggttctgcatgttgttgagatgcttgtcagactgcatatgaatactgaggttgcctttggtagttgtggagtagttacacacctcgcagcggaaaggcttgtaaccacacgtgtagctctcgcctcgtgccagccgggggtggggctgcccgcttttgcagtagacacaggagccccccggctccgggtgcttctccttcatgtgtgcctccagggtctgctggtacttatagtgccagttgcacttggggcacttgagtgtcttacacgagttacgagaatgcatcatggtcatgtggccgcccagcgagcgggaggagcccaggaccgtgtcgcatttggggcactccacgccactccccgaggggcactccccaaccccaagctcgcagagggagccagcgtgctggtgatggggaacgaagcccccatcgtcaccctctgtgctttcatttggttctggtgctgtggcattgtctttattggcactttcgtcagcgaagtccagcctcctgccgccctctgccacattggccctgacgccctcactgttaaagcttaaacgattcctcctgttcgcaccatcaaagacaacaaaggaagaagcagaattagaactagtagaagctgtgcccctcgacagggtctggagcacgttaggcattaagggggagttagaaatgctttggtttgagagagcaaggtcctttttgctgctactacctgctgcggccccaggctcctcatggggcctgtcctccagttcctcatccaactcgcttggaaagagtcctttgcaaccctcgtcttcctcctcctcttcttcctcctcctcttcttcctcctcctcctccgcctcttcctcctcctcttcctcctccgcctcctcttcggctggctctaccttctcagagaagcaatccccgtcgcccacttcctgcttctctccttctgccgccccagagtccttgccctctgaggatttggtaggactggaagccagaggccccagggggactgaggtaatgggggtcttcagtaccgagctggtgagcccgccaaggttcaacagggtgctgggggtcaagagaccagcctggggctgctcggggccagcggcggagcccgctgggagagcttcctccccttccattcgaatgccactaaatttaccataaaaactgtgtccggggcctatgaggttagctgtggaaactaaagggtgttgaaagtttttgttttttggttccagaaaacttacaaggggttccttgtctttgccgatcccttggatgatagcggagatgttcttattgctaagaattttccgctcgtcttcgctcagggtcattcgatggtcatgcaccgcgtgggtcacaaacgaacggacgtacccaaaggagagtttgcacaagaaacacatcaggatgggcttcctcttgccatagagcacaaagccatcgaatttggacaggtccacattgttgggaacatctttggatacgcaggagcttttggcagaaccgtcgctgttcaggtaatccttgttgcttttgtgtcgcacgtcaaacacgcggaagctgtgcaggacggggctgagccccgccagggctgaggtattcgggaaagcctggtctgggccctcaaaccatttcccgaaggatgaggctatgtggaaagtgttgatgatctgcgggtacacgggtgcagcacacgaagggtccccttgcttgccccccgcgccagggagagagttcaggaaaagcgaggggagaggcccactgccactgccactcccacaggcgcccccgccctgggtcagctggctcaggctctccacaatgtacgcggagccgtccggctggtagacgatctccccggccaggttctccacgtcactctcctcgtccccctcctcaccggtgtcgctggcgctctcctctctcaggggtggcggggggcgcgcgctggggcagtggtgctccatgtaggtctggaggctggcaaaggaggccgaacattcgttgcaggtgacctccttgctggcgggctcggaggggggcccggccgacgcggtgctctccgcgaggcgctcattgaagggggccctcaggctgtccaagggcccgtggctctcgcctgtggactgctccatgctactgggtttgtcagggaggtgggtgctgttgagttcagtccattgctggtgctgagggataccgcacccattgtccttccccgagacgacgggcgagtcacagccttccatggtaaggcctgcgtggagctttcattgcacccagtacggaggctcggacctgaagggcagaggcaaggggggaggagggagagaggggaaagagagagagaaaggaaagaggttaggagggccgaggctgaggtcctaccgcacggagcgctctaagaggcttctgtccacaacacagagacacagggcggagggcgggcctggggacactgccccacacggtccagcacacaggggtggcatggccgggtcaacagcctgagcgagggatatggggaaagaaggccaggaacagccctcttcggcttcgaattgtcaccgctctgcccctgaagactagcgggaatttccattctttgccagcatagcttcgatgggccacagtggagaacggacgcgtcatctctccagccctctacgaggtcacagccacagccctaccacttatggacagctcacacgaagtcagccccgactccgcgcactgtctgtgggtcaggggaacacaggggagggctgagaagagggaggttcaatgtccctggaaaaaggacggtaaagtgggataacgctcatggatttagaacaattgcagccgtcgcttttactgaccatggttctagtttgagaagttcaaagaaggcgggtgaggaccctgaggttcacagggcaggtgtacaggactagacacactccgaaaagtcctctccagatctgggaggcgtcagtcccattttacaagcagtaaaacagaggggcttcaatctaaaaactggctcagtgctaatctcaccaccatgaaacagaagaaaagatgggtccccagattcctgtctcctccacccataccagtcaagctccctggcctgtgactctagctgacttcagactaaaactacgtaggtgcaaaacgtgagcttggtatttccagcaggaatggaccagactctggatctgccaacaccccctccagcagcttctatctggccctggctggagggagtgcgttccccacgtgcctggtggtttttgctatcaaggatctgagcagcaagccgagacggcagctgggctcggcgagccccagctccacacctgcctcttagttattagtcgctacccaaccagctgtcgttcagccctggggcttttccatttccgactccaaagtgccactgagctgaatgtgccctctgagacctcatgtccctggggagggaggcatcggatcacggccgctctgctcctgcagtaatatcatcgcaggggcgatcattccgtctggccctgctcctacaggcagctcagcacctcgcagagccctgatcctttgcccgtaggtccccagccaccattcccctgctgctcctcctggagaacatgtggctgctcctccacccaccatctcattcacactcagccggtgaaggtttcggccaggtttgatctcacttccctccctgacagcccctatcttctcaatcttttttttttttcatttcttgattattgactgcacaatgagacaacagctccccctcgggaaaaactggggaaggcaggtttaccagaagtctcagggagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagccgggatacaggtgagactgcagggcggctcttcttagggatgcttctgattggctggatgacatctgattgatagcttgggccaaaaaggttggcaggcctgaaggggcgggagggttaacagcccgattgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcgtttaccaattaattggtgggcttctcttgctccgttctcctcttattcctcctcctcttccacaaactatccagccaagaggctgggacttttaaaacctcccttactttgttttctactccaaagcggaagatgtcaggaaagaatgacactgtacccacctatgatggtggctggtgaccctgtggtggtgacactagagcccacccattcacggggagcagcagccatgaggacacgggtcggagaggaggaacccactgcaggacccaagctacctcccctgggcctcctttccatgcgcaccagctgtgacaaacaggcccgtttgcagccttgccaaacaagcgtggtttgtggacttgaagcattatcctctccggggagcttaagagacatgcactgtctcctcctgccccatcagaatctgcattttcacaccatcctcagggaccatgcattaaacttaagacactctctgcttcactccatcttcaccaatacaggtaccaagcacagctcttctgtccttggtacctgtattgctaggtaaccagggaaggtcagtcttagattccctgtggtccctgggaggtgcagggatggagatggagaagagggggacgcgcgcacagaggtaaagaagtctccccaatccgccacatcctgtggctcaagggtctcagggcatctaccactcccccgcaacagccggctctctctcgctctgtttatcagccagtcaataagaaaaaggtagttcttacttaaggaggcagaagtcaactcggcaggtcgatcagcactctgtctgtaaacacggtttcccgtaaaatcaatgatcttcagttacagagggcagcctgggaacccagtgggtccccgcacttttccaagcagccctgccagcctgacacgcacacctctcttcaggctccctccacgttctgtgccccttcccagtacttccctagtgccagggctagctggtacaggttcacacccctcctcccttcctgcagcccgcttctctgctggtggcacccggaactccctctaaaaaatgtccaggtattctgctcacaacccccaatgttgcactcaacatatgggcttcaagaattcagttagattttaatagagcacatctctccagtgagaaagttaaagggaagataggaatgacctagctggctcactgtctgcttagcacttaaatctgccatctgaaaggtaatcttgtacagaagaattccagcaccttcatcaagtatcccccaactcctgctcatcttccaagctcccttggaaccacctgtaaagcccactgcatctttgcaaatgtcaatctttacttttcaaagattgtttaaaaggataaaactctaccctgttaccctgtatctccctattaatcaaaacgttcatctccctctttaaaaacatgtgctgatgacagttttatcctgttcccttgaggcagaactgggtaaaatgcaacagtttcagggaagctggggtgggaggggtgcagttatgacgaaggggagggggctcctgctgttgctccagctcccggagaatgaaacatgaacagtcgcactgtgtaattttaaattgttaattagcacagggttaattaggcagtcctttcacaagaggctgtctggtaggaaaccaagaagggaaacaaaggggaagggaggaaaaacaaagagagaatagaggcagtgagaaactgttgcctccaagaatatcccatgcgggatcactcaagagacatcagccagcaggcaaggatgcctgattccctgggtgatcccctgctctgccggagggagaagcagtgaataccgccttcctacaggcgaccaggcagcatacatcaaaggcctcagaagtgcacatccctccccgttgactcaacaattccccgttctaggaattcatcataaggaaagaacccaagcaatgcatggagatttaagtttattcatgaaaaacataacaggaaaaaagaggaaaaatttgggcaaaaacagaccctaaataaattacagtgcacagagctccatatgttgttataaagatgctttcttcaaagaaactatttataagcatgggaaaatgatcatacagatgctaaatgaacacagcacatataggtattatggagaggaaaacaggagagacttatattacaatttttacaactgtgaattctagggaatgaggtataggtgacttcatttcctcctatgtgcctttatttcccaaagctctttaaaattaaaaccatcattgagacagtaggattgctagagcccaggagttcaaggctgcagtgagctacgatcgggccactgcattccagcctgggtgacaaaatgagacttggtctatttaaaaaaaaaaaaaaaggaaaaaaattgaaaaccatcatactggaagtcatcacttaatgagttaggtgttgtgttaagacccatgggtacagcatcactttgatcctcatacccacactaggagatagatactatttttatccccattttagaaatgggaaaactgaggtggcccagttatgcagcctgactgacaaaccggagagtatgggtgtggagtctatgctttcaggcagttttcctttgtcacccaggctggagtgcagtggtgcgatctcagctcactgcaacctctgcctcttgggctcaagcgattctcctgcctcaccctcctgagtagctgggcctacaggcgaccaccaccacgtctggctaactttttgtagttttagtatagatggggtttcaccatgttggccaggctggtctcaaactcctgagctcaggcaatctgcccgcctcggcctcccaaagtgctgggattacaggcgtgagccaccgcacctggcctgtttttctttaatgtctaattttcaaaagagaacactagaacatccctacatctcacattcacactcagtctttaagcacccagggactgtcctaaggtgatgggatcccaggactgctcatgcaaaagaacgctggcatctcacccaaacgcccttttcttgcttgagagtgatgggggtgaggggaacagttcaaagcagactgatttgcttggatatctttaggcagacaagagaggataaaggaggtaggagaagctgctgcaaagaactgaaatgtaggtccaatatcctgatttttaaagaaggacaaaaggcaggttccagaacctacagatcaggaaacatattcattcgttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgtaagttcttcatagttttcaaacagattcaagttgctggaaaagaattttaggggtgggatgatcctgaggaattagcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgccattattttaagcgtcaacacagaggtccgtgtgtctcgggacacgccaacaaggctctgtcttgtccctatttggctgactgaaatcaacagcttgaggaacaagaccatgcaggcatgtccacttgcagagcacaccagactcgagggaacaattaaaatgctcaacggtggaatcaagactgaggaaaaaaatctccatgagttggaacaacaggcccaaactaacagaacaaaactttagatggaaaaacatgaagccctacatttaacttcaggcaatctgctaaaccaatagaggatggaagagacttggagtcataagagttcatgcaaacaacaataacaaaatatctaggagttttacttgatgacaaactcagaggaagcccgaagttggcatggtggccaaagaccataatggggcctttggcaacagtactactctgtacctgttggagctcagcaggtccacagcccatcactttctctgtctgcgtgaataatgttaggaaccactccagggaatctcctaagagagataccaacaaagaagctgtagcctcatcggaatggctgaacacacacaccattcacgggtgcagggaagagaagtcccgttgcagggcaaggcagctatcctcggctatatgaaaccctgcctgccacaggcaagtgggtttggttctatgggttccacctagttccagggttgaattaggggcaatgaggggaatctataaggaaagagaggtggggtcactataaatgaaaatctttctcaagattatcacagttcccaaatggaatgtttatgctgtgaaatactgcactctgtggcttcaagaatggagaaggggattgtgctatggccagggggctgtatcaggcagcctatgaaaggtgaagattcttctcattcctgggtgttatctatgggcttgtctgtccccaccacaaggctatgagtggcatgagatcaggttccctgtgctattcatctctgagtcctccacatctgacatgtaataggtgcttaataaaacaatgggggaaataggaaaaaagaggatccctgaatccattccttttctttttttctcttagtttaagacgtgtctggtgtaaccattctccacaaaatggaactggggctccttggagacatggccaattcttgggctggagcaggaaaagttcaagatgagctcggagcatctacttgtgctcaaagaataaggaagatgtgtcaaaatgacctaggagtgggttggaggggctcccagtggccacatcagggacaacgtgagcaagaaaattaagtgacagtaagtgattgcaacccaatgtgtaacataacaatccccaagtccctactttaagaaaaaaaaaagtgtgggagaaaggaaagttcttccacagggtagaaactcaactaataaacgtagaaaaagagtatggagttagaaaatcaccatttgataaccatcatcatcttcatcatcatccactcagggaagaatcaatgggtacccaaactaatggatgaaagtttgaatacttccgggagcggtggctcacgcctgtaatcccagcactttgggaggccgaggcgggcagatcacgaggccaggtaatcgagaccatcctggctaacacggtgaaaccccgtctctactaaaaatacaaaaaaaaaaaaaaaaaattagccgggcgtggtggcgggcgcctgtagtcccagctactcaggaggctgaggcaggagaatggcgtgaacccgggagacacaacttgcagtgagccgagatcgtgccactgcactctatcctgggtgacagagagagaccccatctaaaaaaaaaaaaaaaagtttgaatactaacaggatatttacaatctcaaagtctctccccacaggatacttcttaattatagcaggaaaaaaaaaaacaacaacaataacttcactgtggagaacctggcagacaccaccttcattgagtgatcaaagttcccatcaccagcagtggggcaaacagacgtcatgtgcctcctggtaggatacaccgagaggaacacaacatcccttccctggtgttcctgtcaaaaacgcacaaccggaatctaatcatgagggaacatcaggcaaatccaactgaggacagtctgcagaatgtcctatgctttttagaaatgtcagggccatgcaacggaaagacagactgaagaactgtttcagattaaaagagactaaggagacatgactaatgaacgttatgcataatctgggatcttcttttcctctaaaggacataactgggacaactgacaaaatctgaataaggttttgtagatgggctaatagtggcatatgaatgttaatttccttttttttttttttttttgagacagagtctcgctctgtcgtccaggctggagtgcagtggcgcagtctcagctcactacaacctctgtcgcccaggttcaagcaattcttctgcctcagcctcctaagtagctggaactacagatgcccaccaccacgcctggctaattttttcatatttttaatagagacagggtttcaccacactggccaggctagtttcgaactcctgacctccagtgatccgcccacctcagcctgtcaaagtgctgagattacaggcatgagccactgtgcccagcctcatttcctaattctgataactgcagtgtggttataaaagagaatgtctttgttttttaaaatacacactggtatatttagaggtgaaggggcacaatgcctcgattttcaaatgggttaggaaaaaatatgtgagtgtgtaagtgtgtgtatgtgtatcagtatatacatacatacacatacacatatatacacacatatatatgtacctacatatatacagcaggaataaatatatgagatgttaccataggaggagtctagaaggaggacacgagaattctttgttctactgttaaaacttccctgtacacttgaaattgttaaaagaaaaagaaactgtccagagtaaaaattcgacatagtaaccccccaaaactataaacgaagagtcaacccaccctgacatgcgtatctttaatctttatgtgaaatttgctcccagcagagcttcaaaaaaggaagtggctgtgaggctggacagagaggtgtagagagacaaaaactgaaaactggtctccccttcctccagccaagaggcttctaggtggagccttccagttggagaagacaaataaatggccattccaacttgggcagaacttcacgtaatacaatactgagccgtttccccgtgacactcatgatcctgactgtgggctgatttccctagttccctagggaactttcgcaaagttccctaactttgtgaaaagtgattctaagtaaaaggacgagggcagcccccagagaaaaggagaactccagcagcccccagagtgtgagcattgttaaatccaggctaaaacatatcagagagaaaaacacactacactgaagcaactatcccctcactaaccccacctccttaaaaaaacaaaaacagaaaaacaaaggcaacccagattccaagagaaggtgaaacctccttcaagggtcaaagaaataatacctgcatctgtttagcttggaatccactgaagaaccatacccagttcccttctgtgtttttttacaataacagtgtttgtctactgctgctgcacagaagtcaatatgtgttaagccatacataggtgattccatctgcttggtagcaatttcccagcagccttcaggattgctctgcaagtgtggccaggtcggagaacacacaggtgcttgaacaggcgccttgtgctgccggacgcccactgcccagaaggcccagagaatcgcccaggccgtgggcctccatgtttgctaataagtgcatctgtgctatttccagcatgaacataaatcagcctagaagtgaaaactgctagctcagcccattctgcagggaatccacaaccaccatgatattctggttacagtggagtcgtggagggcaacaggagagagtcgtgacagcggaggcaggtctaggaacccagtctgtgtgtacttagaggaattaaaaaagattttttttttttttactatatatgtaaacatactcagagttcaaccaccatgaatcaaaaccaaacccatgaatataataataaaaagcaagacaaaccagctattatttatgctctgccttgttctaaaaagggatttggggcaatttaaacagctatagtaactgtatctcacacttgagtacgtaagtctctaccctgagtcacgtggaggcctttccaccatttccacaacaagaaagacaagcatcgtgtgcccatgactggcttgactggtgctcctgacttggatttaattaccatagagcacggatcccctcccggatttgcagcagaacctcctttcaccaaataccattgctttacctgactgtaccaacccacctctcctaccttgcaagcccgcagctcacaaccccaaccttcacccatcttctggcactttcccggctaaaccggacaccttctgacactaaccataaccaacacttatgtgtttcctttgccagcactcaaggctttttcatctcctcccaatttcctcaaagtccctctccaagatcctatttctactctctctccactcttgctattgggattatagggcaaaagctaggagacaatgtaaaaacgtgccatctggcccattacagtttcaatctggcatgtcatgatgtcaaatttatgttaaatcatgtcttatgattaaagttgtgggagttcattattttaaaaatttggatatgtacaaaaagactcagcagctaaagttaaaatcactgacaattccaccagctagagaaccactggtaggtagtttttcgggcttttttcctctgcacgtttacagatacagattttccttacctacctcggatcacgctgctgtttatgtaggccgcccttttaacctaatttagtatgaaatttttcctatgccattcaatattcttcataagttaaaactaatggctatatagatactatatcttatacacattgcataatttccaccaaatgctattattagacatttaaacaattcccaatattttgctgttcattttgcaataagggcccttaaatctttgtacacatataacaacaacaacaaaaacaacaaaccaagtagtagctccattactgtccacctggttgaatcaagcatggttttgagcactatttttctgaacatgttgttttgtttgatccttgcggcagcccactttacaggtgaggaaactgaggcttagagagttaagtaccttgcccaagctgcatgctagtttagtcggcctttgaaagtaggtaagcctcccttaccactctaaaactaggctcttactcatgacgttgtgtctgtattgccttaggatgcatttctggaagtagagttgctgactcaaatgctaggaacatttaaggccctctggaacgtgccaaactgtcccccaggaaagtcctttccactcctgcttgcactggtgtgtgagcaccagttttcctgcaccctcatcaacagtgggtatttactttgttatttttaaaagtccgtttgacaggcaagaaatggcatctcattttaactcacattctttactcataagacagaacccatctatggatatttactggcagtctacatttcttttgtgaactgcctattaatttttttttttttttttttttttttgagacggagtttcaccctgctgcccaggttggagtacaatggggcgatctcagctcactgcaacctccacctcctgcattcaagcgattctcctgcctcagcctcccaagcaactgggattacaggtgcaggtgtgcaccatcacggccggctaattttttgtagttttagtagagtcagggtttcaccatgttggccaggctggtcttgaactcctgacctcaggtgatccacccacctcggccacctaaagtgctgggattacaggtgtgagcattcatgcccggccttgcctgttatttctatggcaggtgtgtgttgtccttttctgagtgagtaatgaaagggttttgcagaatttgactggtgatccctcccccttgagttcctaccagtccaccatcctataagctcctggacaggagagagtctgacctacttacactgccagttcagaagatgttctctgtccttcagatctcaactccatccaaagagtggactctgtccactgcttcatttgctccacatcaattttcctgtattcaagtgaagtccccctcctttatgtgattataaagggccaaactgcatcaatcattttcaagctttcttgtgcagtggaaccaactatgcggcacaataaaaatacatatggatgtcaagccccagcccagagcacaagactagctctctgaagggctgggtatctgctccgggagggtgggaaggcactatgtcgccaagatttctgtcctctgtccaaagtcatcggtgtcctcctggtcttggtcaatggttcctcctcctctactttaagcttcaatctcccctgcattcaaaactgcttccccctctactccttgaaatcttcccccacttcacttctgacatattctggccctcctcccacctctgtcatctctacattgcctgtcctctccccattcctacagctctccatgggtacattttccacttattcgataaaattcttttatcatttcaactcacagacatctctcctccctgttctcctgtaggtatttaagcgtcattgtactcttcccccttggctctctgctcttaactctgtacatcagctaccttaactacttctgcggtttcaattactgaaattacgagctgactcccaaagcaaaaatgtccattcctgacttggcacttgaatatgtgtctcatactttcagaagaccagaagatgtctgtacatgcctagtgtcccaccaaccaagactcagcatggctcaacatgtccaaaggacactgccccctcactgtcggccctggtctctctggaaggaacttttggtgccatctttgcagaaaacagaaaggaaagatcagtctggctttcccaatatcatgttcatccccatccttccccatccaagaaacaactaccaaaacacattcaaactgaaactctccagagcggtttcaaatcaccccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggagaaacccactaaaaatacaaaaattagccaggcgtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaaaaatcaggtatgaactacatgcaagtgaacccctgggttcccgcttcctgggaagggctatcaaagccgggttcactagtttaatagaaagatgagtctactatggttcctaagttcctattaggtagctcttagtcagcagaacactaattggaacagaagtaagtgctatcattcaaggctgcacaaacccaagagaaatgaacttggtcagattctttgcacttggcagtttggggaatgcaggcagaagcagccaggagccttaagttttcttttattcacatcgaatctacctgagaacaaatgaagaacatggtacagctgcttttctctgggcctgtggcagctaattagagcacctgggaaacaccattcaacgttgctggacagaggtacgtcctcgcaatgattccgccaaatggcacacacaggacaatggggaaaacctgtaagggtgaggtgagagctggccttgggcgaaggaaagtttcccacagcagttatctccaaaatgactctgaaacaaggagtgtgttttcctctcggcaggaagaaaaccactcggtgggctcaccatcggcagcttgctctggcacgaggctccggaactggcaccatgacaaaacaaacaaggattgccctttggaggctcactgatagggcaacacacacacacacacacacacacacacacacacagcctctcaccaacacgggcacagcgagttcttcagatatccctggcctgctggcataaagagcttttcaagcagtgggaagccaaagggacactcaacaaagcagtaatggccactgtaaggtagagacattggtaaaggcatgaaaaggggatgcctactgcaaaagcaaaatcgtacacggggtcttccccatgccttgactgggcaccctcgagagacccctttgggatgtgcgtactaagcttccacccaacttcctatctggtggaggcatgctatgcacagagaccccatcactgaattccctcctagataactcactgcactagactgaaggcttgagaggtttatttcatcatgagtagtcctcaaatcctagaggcccagagagttgctcctatctcgattctctttcttagggtaaagtgaaccggcagcaagaactaccaccaggacgcaagggctttgagacagactgaagggggcatggattctgctggcactctgagtttgtttgaaagacttccaaattccaaagcttaaaaccctatcagggccaggtgtggtggctcatacctgtaatcccagcactttgggaggccgaggtgggcggatcactggaggtcaggagttcaagacaagcctggccaacatagtgaaacaccctctatactaaaaatacaaaacttagccgggcatggtggcaggcgcctgtgatcccagctaactcaggaggctgaggcagcagaatcacttgaacccgggaggcagaagttgcagtgagctgatcgtgccactgcactccagtctggaagacagagtgagactctgtctcaaacaaaataaaatacaatacaatcaggagagaggggtgtacagggggaagagaggggatcatgaaacgtgatcacatgtccccttcttcatggccccttctccatcccacatggtaattacaaagcccattatttgcactgttacttttaatcaagaaatccatattgagacatacttaccactggccacttcaaagagcggccctgatagttagctaaaataacaaaggaaaatttcttcttgaagtgtaaggatccaagagctcacacttccttaaccttccagaagccacccagagaaccaagtgactgtgggcaataattacaccctcaccaactcagcaaaaatggcacagatggtctttctcctcttgctgctcccaatgctgcgtttgggtcaacagctgctaagaagaaccaccaaggccacgttaaatagtacttggattaattatgcttgaaaatctcttatctgagcactgctaagacagaacaattgagtttgggaatgagtgtggttacatatttttccttaatggcttcctgaacaccctggttaggtctggtcccaggggagaaattgccagctcaagtcataaaatgtgatcaatgtagatcaagaccctgtgctaagtgtctaggatgaaagaggggaagcgtatttgtgcaaacacacaaacatatgaaaaatgcatgttaacataaagaacttcagctttctttctgaagctgcaccctctctcctttcatgcctagagctctgctcattccaccaaaacttccagccagcagttctaatcttggacagcgccagaacaaattttggcaactgttcctgcagttccaaaagattcccatgttaagccatggtaagattcggggaatcaaatctggatggtgaatggggccaatttctttgacttcaataacacagaggctactggggttccagccccagtggtcatagttttaagctcctctgcataatacttatccaactactcactggttgttctaatgatttttattcattcgtgccacaatatttattgagtgcctacaacatacacagcgcgtccctcctgtcgatacagactcctacgagcttgctctcagtagcgtccaggcaggcaaaggaaggaactggaaggcagtgatcaggaccccggtagaaatggactcagcactccacgtggccactgggattcactatgtcaacacaattatctgggttactgctcgcctcattccagagtctacctgctctgatgccagaatctgtccttctattaacaaggtgtggtcacagtgaactgactgaggtccactgtgtttaaaaacactgaccatggcatctcatggctggacaagtggcaccgccgccctgagaccctgcagtgctggggaacccggaggccctgagacctcggttcaactccgccagtgccccgggagttctaacccccacgggggtctcgccttcagtccacatgggagtcacccatcaaaggcattttagggatattttaggttgaccatttcctgacagcccaacatgtttttctctgggatgaagggcatgccatcccacaaatggtgatgagaaattgcagaaccactgaaccggcctacacataagcatttcttctcctttgatgtcgagttgacaagaaaggatatgatttcatttctactggctcctcttaggtaacccaactggtttcccacttcctcacctgccctttgcattcccatcctggtttctttggccttggttcctctttaagctgggaccagcgactttataaactccacacacagtgcagcaggttccagacgcagcgtctggcctccccaggtcttatgaagaggtgctgagggttggcgggttgacacactcactgcactgcacaaggaggtggctcagcccagctttcacgtgaccagtgtccatttatagggtcgcatgctcacgacacatgctgcattatggggaatgctgcagagaggggagtcttattcttaaaggagttagaattgaagcataaagtctaggaactaacatgaaccacctcttagaagtctatgtacaacctgcactcgactttgagttgttccccaactattagttccctgtcgtgggtcagtggggggaaaaaaatcactctccacacagctcttgaggagaggctgggatctctacgattcacttggtgtctacctgcaggggactcagggaaaaaaaaagcaaaagccacaccagcatgagcatatcacacagaaattctactgaccccaaaagcggggcaatgaaaatctgtgcacaatttcaaaccatgcaccccagggtggaggggagagatggaattcaggggaagtgagaagaaaaaggggaagaagaaaaggaccagggattttttttcttttttcttttttttttgagacagagtctcactcttgttgcccaggctggagtgcagtggcacgatctcggctcactgcaacctccgcctcccaggttcaagcaactctcctgcctcagcctcctgagtagctgggaccacaggcgcacaccaccatgcccagctaatttttgtatttttagtagaaacggggtttcaccatgttggccaggatggtctcaaactcctgacctcaggtgacctgcccgcctcatcctcccagagtgctgggattacaggcgtgagccaccgcacccagcctgggattttttttctttctaaggaactctttcccgagcattcacgacccagccctttctgctctgggatggaaagtgttactcagctacaaggcctcttgttaattgtgggtttttatttttatttcctattaccctctcacacgcctgatgagattattttaccggaactgacacagctggaagcagcaggcatacgtggagcctctgaggaggtgatgcaatttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaagtgctctcctcccagaaaaataaaagaccagcgccacgctgctggcctaggagagcatcggccgggggtgggagacatcgttggactctgaaccaacaaggcacctcggtgcttctctatggattacagcaaagtcttccagggatgcagaataaacatccttacaaccaatctccacagccccttgggatccccttccaaatgtcaacaaacaagaaaaggggaggccactatacaacagttgtaaagatgtcctccagccagtcatagagatgatcctgaaggcacttaccatttattgagtgcctactatgtgccaggcactgtgctaggtgcttaccatgcccagactctggtcctcacctaaccctctaggacagatgttcttctccctctctctcctggatagatgaagaggcagaggtctaggaaggtaaaggagagaaccagttggtaccaacaccttcctgagggtcaggccaaactctcacaagcagcaaaggaaagctgagtgtcaacaggagagctcacacctgagtcctaagagagcgtggagcacatgtgatgggctactttactcttttacagatgtagcagatgatagattgtgactaatccacctccatcatcctcagcacccaacaacagcgctcctgtgtccaaggctggaaccacaggtgggcttctcttcggaatacgcagaatggttactgttttagcagttaagatccctccaactgtttgcctgccaaatattgctttgcttacctaaggcctatggaaaaaacagcaaggagctcctcaaaaagacaagttctatgaaaaacaccaccagccaggtggctctccagacctccacaggccatttcgccataggaaagatggatcacagaagaaccagggcacagtccgaaattaacactgctccccacaactcttcactgttaaaatggaaattttacatggaccagtgatggcaatgtgtccaaccaaaatctctcaggaagcttttattgagtacctaatctgtgcctcaacaaagcaaagaatatataagacatggaccccgaaatcaatgcgcttacagactaggtgatggccccataagaatacctagcacacagttatttattgatcctgtttacaatatacaatacaacatcatagcataaattgaggcccgggcaaaagaagaaagaaaaaacaaaactggaggaaattttgaaccaaaaaaatcaagcttaaaatgcatgtaagaataacctacacactgagtcaaatttggctctaagctttctaaaagtcaagaggataaaggcatgctaggtatgcttttaaaggtacactatttacaatgtccaagagaaaaaaaaatcaattggtcaggattatttagctccagtaatttctcaactgctgagaatgggataagactaggtgcaagtagggcgtgcagccctatttcccggatctctttgtggaggtaataatgagaaggcttgagtgtgaggccagctagtctcactgtttccactgatagacaagaatactgaccccacagggtgttggtggtttgctgacgtcagagagccggtcagtggcagagctaggacgaagacctgggtatcttcacaccacactaacagtgccttcctcccacatgaagctactccgcatcatccttttaaatccacaggctggctggatgggtaggggctcacatggacgttggggaaggaggagaactgttctagattaaaggggacctaagaaccaaacaacagctagatgcgctatgtagtttcgtatggatgccagttctaaccagccaaatgtaaaaagccattttggggacaatcagataagtctgaattgcaacttgggattagatcatgttaataatgtcagttttggccaggggcagtggctcaaacctcaagtatcagcactttgggaggctgagacgggcagattgcttgagcccaggagtctgagaccagcccgggcaacaaggtgaaaccccatcactaccaaaagttaaaaaaaaaaaaacaaaaacagctgggtgcagtggtgtgcgcctgtagtcccagctacttgattgcttgagaccagggaggtcaaggctgcaatgagctgtgatcgcaccactgtactctagcttgggccacagagtgagaccttgtctcaaaaaaagtcagttttgttagggaataatattatgtttacataagaaaatgatgaagcagcatgatatcgttggcttcaaaatatttcagcaacggacaaaaaagacggaacaaatctagccaaaagttcattgttaagtcaaggtgatagaactatggaagggttcattatatcattctttctacttttatacagtaattttttttttccttaaaagttaccattcgctatcaggaacatcttctaaaagaacagcattgaccagaaccaagagattcagtcttgagtcaatacgttcatggcaagccaagccttttttcaaagaaatgtgggtttctcctttcttccgaagggctttcctcccaggccgggccccagctatctctaaagctcctttcaaacaccaccatctactgacccccactcttactccttctcttagaaggtaccaagcaccaccaggctgctaatgtttaaaagaacacagaaaaagacaatatgcatcacgcctgggcatagcacctgacagcctttataagtggtagctatcacgatcattactgagcaaaaatgcgcctgtttacaaaagttaacagcctaaggttatataacagcttgatttcaagctttgagccaaagtctgattaagaagaatatacatccgttgaattaaaagcctccacttcttgactcaacgggttaagaaaatatttttaacactttcagtgagtttaaaaaatcagatgtttaccagccattgtttttgcgcacactgtcttttatctcagcatgaatgttttataagcaccttaattgctttgcaaagcctcaactgaactgctcccaattgggctggttctctagtgtggctctgtaggtaaacggcccagtggtaagtgggcttctggccatatgtgggcccatacccacccccaacatccagcacaccctccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttttttttcctgagatggagtctcgctctgtcatccaggctggaatgcagtggcgccatctcggctcactgcaacctccacctcccgggttcaagcgattctcctgcttcagcctcctgagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccagcctttctacacattttcaaacactctcatttgacctctaacaatctttttaaatagaatgggaatcatattttcgattttacaggtttaaaaaaataattcattcaaacatctgagtgactcctacgagtcattctttctcaaggtcctgcaactggttagctgcagagcaaggaccaggacacaagctacagtttctactgtggtgctcttggctccatgaaggcatcatttccttaaagagaatcaccaactcacagagaaacaagaagaataaagacagaaacctacctgctgcatgcctaagcttccaaatccttccaaaacatgtatcatctaaatacgagaaaaagataggatgccaaagacccaaaggaggtattttcattgatcacacctcagtggagtagagttatacacaccaccaaatattgagttgctccacacagaccagaacagtgatggcaagacattaagtcgtaaatttttacataggccagaatggtggagggcccgagaaacaaatccactaaagcaccaagtgctgaagcaaggatctttggcccataaaaaagtttaagatctgaggagtagcctgggtgcaactcctcctcttagaccctagactgcaaagacaacactgtcatccaaagcagactgaccactcggctcaaaaggctatttgtaaaaagatgtaataagctgtcaacgtccaggagctcctcatgaaggaggctgaactcagaggagctcatgtcaacgcagagttcaggttaggaccagtgggggtaacgtaaagggtgatttgggccccaggattactgtagcatgacccaagcaaagtgcacatatctatgtaaaacagaaaagaaggaaaccggcttcttccccgtcaggaatgtcgcttattctatgggtgtgagcagtttctttagtccactttctgccatcacggtggagcccttggaagcccctgttcctaccgtgatagaaaacaatgagacttatgaggcaacttaataaccactgaccaccttcttagtccaactgactaagctgagtgacatttttaggaagagcattaatgcggaaaacaaacctttccaattcatggaatgaggtaatctgggcagaggaagggtgggggcagagtgagtagatccagaacacaaaacaatgaccaggatccccgaacatcccagctggaatgagggcaaccccaaaggggtcgacagagaaggcctaggccaggtgcgatggctcatgtctgtaatcctagcattttgggaggccgaggcgggaggatcacttgagcctggcagttcgaggccagccacagcaacatagtaagacccccatctctacaaaaattaaaaaattagctgggagtggtggcacccacctgtagtcccagctactcaggaggatgagatagaaggatcgcttgagcccaggagttcgaggctgcagtgagctatgaacgtgcccctgcactccagcctgggtgacagatcaagatcttgtctcagaaaaaaaaaaagagagagagagagaaaggctgcttaagccattgctccatgcaactctccaaccacatgtcaaacaccattcctaccatctgtccttggagcccttccctcaccagcacaggtctaactacccactgccaagtgtgggtacagggtaaggccctgctcagtaagcctgtggtctgatactaaagtcatatcttgccattaccccccggccccaccagttatagtccagaaccttccatcttgctgttggctctctatggcctggcttcctgaccctgttttgcatgaacccttgaccagctggggcttaaatcccatgggtgggaatctcatacacctgcagccttcttgcctatacctgctcacgctccttcaagcacaggcctcagcccttatctgaataacctgtctgctggcttcctccccatctgatagtttcactcctggctcctctcaggcagcaaagaggaataagcaagccacaggctgcagcctggcaagacagtcaggaaggtggcagctgccctgattcaaccttcctcctagtctatctactgcctcttcctcctccattccccagtgactccatgaaacttgtgttcacaaacttgaaaaattcactggtgaggccaggtgcagtggctcatgcctataatcccagtactctgggaggctgaggtgggaggatcacttgagcccagaagtttgagaccagcctgggcaacacagtgcgacctcgtctctataaatccttaaaaattagccagacatggtggtgcacgcctgtgaatccagctacttgggaggctgaggtgtgaagatcacttgagctcaagaggttgaggctgcaaggagccacgatcacaccactccactcctgcctgggccaaagagcaagactctgactcaaaaaaaaaaaaaaaaattcactgaggagatgtggtagatggcttagaggtcaatgttataggtcaatgtcccttaggttgaacagcacctgtgttgctgggtctgcaatgttgaggaccccgtgatggtcttcaataaggctggggcgaaggggctaaacctcactatcgtgtgcaagctcaccccaggcctcaacagaatttatacatataaaatttatatgcattacatgtttacatatgtatgtatacatgtacatgtatatagtatacatatggatatatttatataaatatgcatatatacctatacacatatacacatacatctctcatatttaaaacaaaatagagcaattaaaagaggaaaaaaacaaagccaacacacacgtacccctaccaccaccactacgaacaccaacacgcccccacaggcaagatcttgtcccaagtttctgagaaacgtcacttaatactacgtaatctcgaaatgatggggtctgcctactggctttgtctggagactggactccagctgctctcctaaactgtccttgtcaccttctcatcaggagaaaaggggaacgtaaacatgaaccacaccagagatgggctatccagtgaggctgatatcatctcaggcgccaccgacatctctctccagcattctgtcatcttatgatcaactatgtaactccagacatccaggggaacctgaatcctagaactagatgtccccaaataagtggtttctctgtaaaagtcaaatgtggatcacaaaacaaatgtgaggggagtcccaggaaagccagttgcataagggtgtcctcaattaaattctacacacgtcaatttttccccagggagggcgaggcagagctgagaacaacattggactggacagactcaaggcagggaagaaatggaattttcgctcttgagattcaaattcctgagtcatagttgaaatcccactgctataattgttttaatacactgtctccacacacacaaaaagacgcctttaaaaagttgtactggcttccagattccctggttaaaaccctcccttctcctggacgctctcagatacaagctgtgttgaactcactagcagctgtcacattctggcacttgcttgggctgtgaccagagcagtcttccgcccaaccagggaaggcacaggctctgccggcagagcaggggttaatggaagctgaccgcagcacagttgttaaggtaatcaataccactgagatactaaagcagtgtaagccacaatattgattgccaagcagatgataaaactgtttattatgataattgcagggtccctgcaagatgctcccagcgcttcctaaagctgtttacaaaactaataaagatttgccatttcaaggtcttccatttttaaccaccccccaccccgccaactccccacaatctcccactcccaaaaagcaggcctcacccctgggcggttaacatgttcttcccagggacaggcactccatggcccgtcctgggtggagcttcactctcagattctctaaagaacagactgtccttctccaccctcaccctgcccccaacttcaggaaggggaggacggaagcacagccgacagccactcagggccttcagatttcctccttaggacccgccatgtgataattatggggttttatcgatggaggggggctgctcagggctccttgggctgacatccatttgttctaacacatttaagaaaccacaccaccttggtttgtaattaaaacttctctggagaacttggtggccatgaagctaactgaacatggtcaaatgctgattgtagaatgcatttccgccaacactactcaactgtgacttgggctgctgaactgggcttgggtcccaagttctatcatgcccaaggcacccatttagtttttattagcagtggaaattaactccttcttggtcacagacaccaccgttttcctcgagacgcaagttattgaattatcggcaccgtctccaatgctgtcacctcatgttcaagaggaactgcaatgcagacatatttttcaatataagtaggcatctcgcaggtagtataatcatgttcttcggacctcttaggggaaagccactgggtcctgcgattaaggatggcagccccaggacttcagggctctgcaaatataccgaaggtgtgttttcagagtgtgaaatggaaaaaacatagaacccagccaggtgcagtggctcatacctgtaattccagaacttttggaggccgagtcagacagaccgcttgagcccaggagtttgagatcagcctgggtaacacgacgaaaacaaaaccccacctctacgaaaaacacaaaaattagcaaggtgtggtggcgagcacctgtagccccagttactcgggagactgaggtgggagaatcaccagagtccaggaggctgaggctgcagtgagttgtgggagctgtgatccagccactacacgccagcctgggcaacaaagtgagatcctgtctcaacacaaaacaaagaactcaagttttaaggagaattcagtagtcattccatcagcagctagaaggcaagcacccatccctcactcaactctcatagcagctaagaatattttacctgtaatagacttctacagcactaggccttcaaaacaacatttgcaattgaagggacaccactttgagagctgacaggccaaagtaagatgatgtggaggctgcttccacctcccaccctccccgatcaaagcatggagaaatcattcaccagtgctcctggtctccgttgccactgccacctcagtttaggtagagggacctctacctgccctattttcttcccattcagctgcaaccagcagctctgggaggtcattgcccccacactgtgcctgtgtacacatgtatgcttcaatggtgtggaccagtacagacatgcagctcctttatagacatctggttctgccccacctactcccaaacacacagaaatcagaacactggagccagttttatgtagagtatcattcgtttgccaaagaccttgccatgaactcatggataccacagcatggctggaagggatgcaccagggattcctttaacctggctacctgctcttagaggaactatttggcaaccaggaatggccggagggaatctgaggcttccctaggactgcctttcatgaatcacctgctcctaggcaaagtggcaaaggacagacaaacgccacctactgaactccaagctggacgccctattcattcacatatgctcacggggcccatgttaacaaacacctccctggatttgataccaaaagaaagtttaatattatatgtggctaattctgctgttaccttttaacctcacttgcacatatctgtcctcccaacaataacttcagcaaaaaacataccctaagaacaatatggtccacacttggaaacccgcccaacagggccagtcgagcctgcataagtgctaagaaccatttaggagcactgtaaaccattaaggccattagctctaatttgacctccacaaaatacatcaacccactaggaacaaatttagaagctttccaaagtcaagttctcaaaacctgaaaggctcataagcacagtctagggcagggaacagccagccagtcccggagctactcttcccgctcccacctttcctgcagctgactgaagggtgcatgcttagctggtacacggacccaagatccttctccagccactggatcaggaagctgtggccatcgaggggtcgatatgcaggctggaacccgccaaacatttctgattaagggattcactccagccttcctctgagctcacaccatatacaatcttccctctgcactgctctaaatcacttcttttcaaataacgcggatttctggattcatttccaagtgatcctgattggaattcaattgcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaagcaggcaatgaaataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactcttggcctgggcaagacagcaagacgctgtctcaaattaaaaaaaaaaaaaaattaaaacagagccaggtgcggctgttcatgactataataccagcaccttgggaggccgaagcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaaaaaaaaaaaaagaaaccatggcactatcaaactccaccagccaatgcgagaagcaggctaagaacacgcatactaggtaagtggacagtgcacatggataagtcaacaatccttcagttgcttcaatgacaaaaacataccacatacttatttcactcatctttccagggcagaaggaagaaataagtgggaagaatatgggccaaatgagttagcagtaacaggagaagcaagatgcagcacacagagttctacagcccaggaagaattgccaaaagctgagtaatccattccagctccaccctgcatgaatttccaggtatcaaattatatgttaattatgcggacgcagagttatatgtggggaagtggtgttagtcagcacccaaggggtggaaattcagtaaaaatttagttttgtcaagtatgtttcatgcacaggcctggggctcctctggctcaggaaaagagaaagcaggagtcaggaggcccagacctttccctaacagggtcccacagccaattcgctggccctctctagaccaactttcccgaattataaaataccacaaggtttgggtttttttccccccaccgtttctgttcaaatcaaaaagcgctaagtcctggctgatttctgactcagccagtcaaaagagggacacgcctccctaactgcaggagggtggggaagggcagctgcactcagtccgatggaggggaaaccagtaaacccgtcccttggcactgtcacttggcaatttctgaggtttaagacgacacggcgttctcccaggtcctggcctgtaaatgccagggaaacgcattgtacttgtgaagagagagaacacagagtttcgaaactgctctaaagcccatgtctcaggctgcaagaacgttatcagtctcacacatcgtgcccctgcctccaaggcccccatcaccacatactgatcttgccctgatttgaagcgggcgggagagagctatggggaagtccaggcctgtcccagccacggatgggacaaacagacaggaactgagtgctgaagaccttgctgtagctgctgagcgatcttaaaagggatccaccctggaggagctgagcaccctcttctttccagttctcctcactttaaacgatttttgtctaataatgtacccaacaggcagatatcagagaagcactaaactaacaccttgaaatgggtcaataatggctgggcgcagtggctcatgcctgtaatcccagtactctgagagtccgaggcaggtggatcactcgaggccaggacttcgagaccagcctgagcaacatggcgaaaccctgccactactaaaatacaaaaattagccgggtgtggcggcacatgcctgtaatcccagctactcgagaggctgaggtacaagaatcgcttaaactcgggaggcggaggttgcagtgaaccaagatcgcgtcactgcactccagcctgggtgacagagtgagaccctgtctcaaaaaataaaattaaaaaaaaaaaaagagagagaaatgggttaatgacaaagaagtcctatacacagcatagtatgtactgtatagcattaggataatatagtatagcagtcccttatccgaggcttcatcttccatgacctcagttacccacattacagtacagtaagatattctgagagagaggagagaccatattcccataactgtcattacaggatattgttttaattgttctattttattattagttatcactgttaatctcttactgtgcctaatttataaattaaattttatcataggcatgtaggtagagaaaaaaacatagtctacctagggtttgatactatcctccctctcagacattccactaagtgtcttggaatgtctccccaaggataaagagggactgctgtcgtggctaggagtatatgctctgagctggcatcccagcgcagaggccatttaacagcagcaaatttgctacagactttgggcctcaagttcatcactcatatgatgggtgtaggatcatctttaccccatagggttgtaaggattaatgagacagtgaagtatttagcacagtagatgcttaataggggttagctattaatgcttatattaatatttattaacatttatacagacaaagaacatgttctcatgtcatttgcatagcaatccaacaaaggccgtattctcacttttgaggctcagagaagcagagagacttgtccatggtcacacacaagtactcagacttccaggccagtgtcttttccatcatcttttttcagggtgtttcacccacgcaacactggccaggggctagatggttccaggtgggagtgggtgaactttgtacattctggtcattagccagtcaatgtttatctgagccaatccaaccagcacgagcctgtgattcctcagacacaattgctcgggatgatgctaaggtgggtatttgtggttataacggaggatcccgtgaaaagaaaaatgtaaagcaaataatacagtataggcagtacaaagaaacaacagaaatgatgccctgagttgggggcagaggggtctcttccactctcagaggctgtcgccgaactgatctttctcacatagtcaaccattaaaagtccccaacccacaggtcctagtttcttctaagtatccatctccctccttgctagagcagagcctccaaaatgaaagcgtttctccgccttcctccaggcctcctgagaaaggttatgagatgggttatcagcctctctgacctctgcagccatcaacagcacttctgcctctcccatcccccacagcgaggatcctacagcccagagccagcttccctgccttcccccattaatgcctttcccctccaacagctatcacaagagggctgtttagtgagaggacctccggctgacctttgctgacaggctccaagctctccctgtaaacggatctaatgtgaggctgggtaattagcaaccaagtagtaattgcagcttctaactatgctcggccaagattgcaaaaattccctaggggggtgcctcctagggatcccaacccacacaaaggcatttactcacagccaaaagaggggactcagccacatttctcatggaggccagcacttctctaggtcttaattaaagtggcacccatgtaaagagacagacagcaaaaggaaattagcaaataaaggagactgaccaagaaagaaatgtatggcttgcttggaacagcccattcagaaaggtacaacctctcaaggtggatggccgtgcacacgaaactcattccagccgcggaaggaaggcaccaaagagccttcgaggggcatcaaaaactgcagaaaggccaggcgcgatggcccctgcctataatcctagcactctgggaggctgagacgggtggatcacctgaggtcaggagtttgagaccagcctggccaacatggtgagaccccatctctactaaaaatagaaaaattagccgggcatggcgctaggcgcctgtaatcccagctactcccaggctgaggcaggagaatcgcttgaacctgggaggtggaggctgtggtgagccgagatcgcaccactgcaccccagcctgggtgacagagctagtctccatctcaaacaaacaaacaaaaaaaacaagaactgcaaaaaggcaggacacatgaagacaggtcccccggcctggctggccagcctggctgcctgctcctatcacccactcaaccaaaatcactcctcacccaagcaccctgtatggcccactgttcgcatcacaagattctagatgccaggccatgtggtctatgctaagagatccgtagtatcatctgctatgatttggtgattccaccagacctgtccacaggcccccctaccgttagctgcctacatgtattaacatgtttcagaataacgtgcaaaatccccattgagaaataaagatgtgagcacttccaaatagagcagctgccctcctcatgactctaaaaatacctaaaactgcacaaaaaagaacattgtcagacgaaaagaatcatccctcctcactctaacaggacaacaagcgatgcccaacagcacagcagcgcctgtttcatccttcctaagaaaaccctttatttttcaagcccaccactccccactccaatttcctttatctgttttgtacttaaaaagtcacttcactgaactgctgtttgctcacgataactcctgaacctctgtcctcaggagaggcggcaagttcagggggcatggtagctttcccacgtggaccagactttctgccaacctgaattacaccctagacgtcttcaaacttcatttcctctgccactgtgctgcccgatcccccaatgcattcggggctgtagagactctctgggttgaatccagttataaaaaccagggtagcagcagccgagtgcactaattcaccctccatttccttctccaaacaattaatatacttaataactccagccccgacgacagatttctcagacacccctctattaacctctccccgctacaagcagtgggtctccaccagaattcttctgttccctatcacttaatcattttttaatccacaacaaggactttgtgccacactgtggttttgttctctcttaatcttttataagggaccttatcaaaagcttttagaaaatacaagtgaattttgcctaccaggtcatctttattattttagaattctttatgaagaaattatagactttaacattgtaaatgaatatttaagactcagcattcacttagacatgcaagtctggctcaggttatatttaagtcgctgtattacttccaccttcagaaggattcttgtctgcctcctgggatggaatgacttcccctccccaagcccccaggtgccatttctgggattcccccaagactttctggaccagctgaaattgagtccatattgagtaccaatgggacttagagtgcattaacagaacctcaaaccaaggaacaaaagtcatcgagccaagggggcctggctatggcagcctatccgactcctacctcctctacctttccccaggtggatggcagggagcagcaggctcccctgcctcacagctggcccgcacatctgcagggagccaatgacagcttcttgatgttgacatcacttaggctgcctcctaacacttgtttgttgtagctattatttctaattagcacttctcaacagaaccagtgctcagcaccaaggttcctcctgacggaacaattaaagaggcacaaggggcgggggtgtttcctaaaattattctcttggcaggtttcaaggtaaatcatctagtcaaatgcacatctcttcaagagctgcctgtggacagggttgaaaagctgtagcaatattccggaacccctgtttgaaagcattcccatcaagttaaatgaagggttaaggtaatccaattacaccaatgtgttttcctgatcaccaggggaatcctcagccttccccgtaatctgctcctaacgccccatttagtccaatgctgcactccaatcaccaaaaatgtagacagggttcccactcctacagccagatgagaggtgcctgccccttctccaaaatgggatggtgaaattaacacatttcagaaaatattctacagagtccagagtccagggcacgctttatccttgaggaaaataataaatgtcgagtcctaatggcatgtcaattaaaggggtcaccataaacaagctgttcaaactttcccctccactcttcgcccgtgcctctccaatctgggtgccctggaggacggaacgggaactgcagatccaggcactccattatggcaacccagcaagcagttcagcacggacttaatgagctcttggaaggaaacaggaagtctataaagtaatttaaataacttccagtcctgaaataaaggaaattaaaccgctggcacaaacctctctgatggacaccttctttgtccctccgatcacaactacaactacagcggtcatattgctctccccaagaccaggccccaaattcccctaatatgaaacacaaaggctgtcagtcctcagagctctccaagctcctgcagaggcttaagccatggatgtggcatggtgtgcagcaagaacacgggaatccgcccacaaaccccgcgctgggtcctgccactccctagctgcaagaccttgggccaatcatgcaacttcacagggcctcagcgtttcaccatcaacaaaggaaagctctgggcctggccaaatgacttctaagattattaagagggtcaaatgagcacatatgagaacagcgccaattgaaaacacaaataaacgtcggtattttccagctgcccagggccttaggctccagaatttctcgatgttctgctcaggaggcactgtcctatcttggtaattatgaaggcatattcatacgttcttttactgccaggtgcggtggctcacgtctgtaatcccaacactttgggacaccaaggcgggtggatcacctgaggtcaggagttccagaccagcctggccaacacagtaaaaccctgtctctactaaacacacacacacacacacacacacacacgagccgggcatggtggcgggcacctgtaatctcagctactcaggaggctcaggcagaagaatcacttgaacctgggaggctgagattggagtgagctgagctcgtgccactgcactccagcctggtgacagagcaagactccaacataaaataaataaattaattaattaattcgttcttttgcttctcctaagcccctcagtgtagatacttatttgcatggacaatgatcagtccaactaagcatgattttcttatcagcagagactgtgtcttctcatcttctgtaaaccagtgtgcccagagccagagcaccaagcagccaagaagctggtcctcaataaagggctagaatctataacccatgcagttatccagacatccttaagcaccaaaatgctaacaactatccatcaactctctacaaaaagagacaaacctaataacaagataaattccataactggttgtgagcctacaaggcggggaggggctgggggcgtgggaaccccgcctgtgcaactccttgcattaccaggccctgccctgagtgcaatccaaccacggagttctggcagtttcacctggtaaacctaagctgctggatgctaaggactgtttctggccacagagttaagtttactttgttgataataatcagccagatatggactggtctgaccagtactccggatccaggatcacaaagaaaagacaaacttaaaagaagcttaaggtcagcctcgttttgctagccctctaggtattactactgacaactggtatggtcaacccttgacccctaaactggtaaaagccaagagtaaggctggacattcagtgtggccaagaaagctacccagcttctgggcagaagcgcaagatcctggtgctccggaaagagaaccgttgggcccggctcaaaaacagaccctcccaaaccaaccctgagaaaggaaatcacaaacagaaatctaacttttctataagggcacactgcacaagtgttcctgcagcttcacaaacaggttctgtgggaatctgctctatcgctcccatctgtcactggcggggtaagatctgtcttgcatatcatggcggtctccatcccactggagaattcaatggtgctgtcttgcatatgggctgtgaaacttgaacaaccggattctgagggtccagacgtctctgtttgagcaacagctgccttcctttaaaggtcccacagttgagcaatagagttctttactcaagagggctgttccaagtcttgagtaaccacccttgccctcaagggttccccagggtgaagccccattgcctctgcctcaccaaggaggcagcgactcagtcttctcgctacacatctgtctcctcactttccagtcagatcacagccagtgggacacaatctgacaaagttctgtctaaggtggggtaatctgaaaagcaaatacagatcatctccccccagacttattcacagcactccccactggagccaggtttgactttccacaaagttcactggccagaatcataacccacacatctatggctcttccttctttaaccatctttcatgtaaatccttcatctaaaaggggaaccacctatctatgaactttaaatttcccagtatccatgttaaaaaaggggaggggcctggtgcagtggctcacagctgcaatcctgacactttgggaggccgaggcggcaagatcgcttgagcccaggagttccaagaccagcctgggcaacacagggaaagcctatctctacaaaaaaagaaaaaaattagctgggtgtgatggtgtgcacctctggtcccagctactcaggaggctgggataggagaattgcttgagcctgggaggtggaggctgcagtgagccatgattgcaccactgtactcccgtgatttaaagcaagaccctgtccaaacaacaaaaatgaaaacataaaaacaaaaaaataattcaaggctaggtgcggtggctcacacctataatctcagcactttgggaggccaaggcaggcagattacctgaggtcgggagtttgagaccagcctggccaacatggtgaaaccccatctctactaaaaatacaaaaattaaccaggtgtggtggtgcatgcctgtaatcccagctgctcaggaggctgaggcacaagaattgcttgaatccaggaggcagagtttgtagtgagccaagatcatgccaccacactccagcctgggcaacagactgagactctgtctcaaaaaataataatactaataaggggaaaaaagaaacaggtgaaattcattgtaatatgtcttatttaaccgaatctgtctacacattatttcaaacgtaatcgatctaggttttattaagacagtttccccttgttttcctactaagcctgggaaaactggtatgtgttccacactcacagtatggctcagggcgaaccagccacatttcgggtgcttaggggccacatactgcagtaatgtaaaaccctggcttcctctaatcatgagaacctaaaacataactctgatctggccccactgtaataattcatgcttgtagttctcactcacagactttacagaacttaccgctgctcaagactctttcccacggcattaacaattatatttgggtgacatgtcaagaagttaagctgcccgggcctggagttaacagattttcacagaattgtgtacaacttatctggtccatcagatcgtctctctggggcttgtccaccattaaactagacccctggggtttcttaatttaaaatcctcataaccctttaacttgaaaactcactgtctttgcaatgacatgtggttaactctgtagtagccacataaacatctcctcattcttaaacaggagacttccattttgacctaatctgagattattctgaattatttctgccctagtcacatgtacgctacagacatgagattacacagaataatcaactgaggtggtgcctacacaatcttttgtttttttgttttgagacaaagtcccgctctgtcgcctaggctggagtgcagtggcaccatcttccctcactgcaacctccgcctctcaggttcccaggttcaagcaattctcctgcctcagcctcctgagtagctgggattataggcacatgccgccacacccggctaatttttgtatttttagtagatacagggtttcgcatgttggccaggctggtctcgaactcctgacctcaagtgatcctcccacctcagcctcccaaagtgctgggattacaggcatgagccaacatgcctggatacctggaaaatcttaaggcacaaacaaacacaggacaaatccacaggcttgggaatcactataagcagaagaaaaatgtccacagggcataaactttggaggcatgctcacagcaaccgctaaccagaaaacttcgcaggctcagtccagatctgggcaggattggctcaggggtgacccatctatcctgagagctgtcaggaccccatcctattgggcacgatacaagtcagacatgggacagccttcgatgccagcgtgggcaggggtctcacctgagcccacgagaccacacacactttggcagcaactcttgaatcagtcaattttcttcacaccataagtacatacttcactctctccgctcagcagctgcacctgccctatctggtggagtggaggacactggcaagctgaaagcttctgcaggctcatccatccagattcagctctaagagcagggcaacccggggaaaatggaaacatacagaaaacagttcacttctggcttgtcgctttggctgcaggcaagagaaggtgtgcacagagttttgaaggaaagactggaatgggctgacactgggctttgttcccggagccccatggggacagggctggcttccgaacctagaaatgcagagagctgctctccaacaggtggagggcccacccgagtaagtatcccgggcagaagaacagagcaggcaccactgtctgtcaacaccaggctcggcatcctcccatcccccagggtccctcgacctgtccccagggcactggagagaggagggagggacgaagggcacgcggtgaaaggaaggaaggaggcgcctcttcttggcgagctgatgggtgtgagtggtgagcatgaattaaaaagccatccgggaacaatggtcttttcatatttggagcctgttctgcacaaagctcagcttgttctagtgggaggactctgctttccatttttttcctaactcatttcctagggttgtggcaatgtctggcactcggctcaacccaatagagtatcctttaactgaaggatgtgccaggcaggcctcctccttgacttcgtaagtggtggcattgagacacacaaaaagggacaacttcaggaagcttttctgtctcgacccgtgggctcccaaagagctcctgggtgtttctctgaatagctgcctaacccacagaaacacacactggatgttttcagcggccaaacacccatttccctctcaaattacgctagacatgccacacccagcagacactccaaagcctaactggaaaaggacagcggatgggcgtcagatcatgtgacaagaccttcctccacgttcgacacactcctggagtctctgctgaaccccacaaaccccttaggcaaagcaattttgaaactgggggtggagacaagaacagcagccaacactaagcaatgaagctgttcctgacacttgaacaaactgtcgcctcactcagtccttatgatccctggtgggcagcctctaagccagatcctccaatcccaccccgtggcattcacacccttgtgtagtcccctccccttgggagtgagcaatacatagggactcacttcttaccaacagcatgcaaatggaataggacaaatgtgataggacaccacttctgagatgaggctgcaaagaaaccgtcattttagtcatctgcacccttctcctcctcctctcccttatggaagccaagtgccccattgtgagctgctctgtggtgagacccacatggcaaagaactgagagcagcctccagccagcagctcttggggaaatgaatcctatcaacaaccgtgtgtgtgagcacagatttcagtctgtccccagtcaagtcttcagatgagaccacggccccaggtaaacactttgaccttgcagcaggggacccagctacgccacagcccgattcctgacccacagaaactgtaagataataagtgcttgccattttaagctactgaacttaggggtaatctgtgatgcagcaatagataacaatacacatctccattttgcaaatgaaaagatataatggaggccaggagtgctgactcatgcctgtggtcccaacactttgggaggctgaagtgagaggatcacttcagctcagaggttcaagaccagcctgggcaagatagcaagactctgtctctacaaaattttttttaaaaaaaggttagccaagtgtggtggcacatgactgtcgtcccagctattcaggaggctgaggtggaaggatgccttgagcccgggaggtcaaggctgcagtgagccctgactgcaccaccacgcacttcagcttggacaagacagtgagacccttcaaaaaaaaaagggggggaaagaaaagaaaatatataattttggccagtaagtagcagagattctcacttaggccagactgactctctctagccaccttcctctcaccatgtggcattacctatcaagcccacattccggtccatagaccagaaaagcagcaaaactccctgggcctctctccatcctcacagatgacagagacacctaacagtcatgcccccaaataaaaggataccagattgctttggaattttagggttgaagaaagagtgaggagagaatccagtctaactttcttttacagataaagcatctgagacccacagccataaagtaacggacatggaactcaaacccccgccaggatagcacgtgactctttagggattccaggaaacttctactcaaacatgctgaacaagcttctacttctctggccaggagaactccatcagtaactctggtcttctcttttggcacaccaagattaatgctctgtggtggctggctcccctggcacttggcagcttctcctatacctgccccctaagtccttccacaaagtgacgagatagagaaggtagatcagagcgtcttctccttggttaataccagaatcgacatatcacatatcacaactgcatactgcccacccagcttatgctgaggtgtgatctaagtttgctttgaaattcagtgacatatcagaaagacagcacacacatttccatcaagacagctaacttgggcaaaggtgttctcaagtacccaaggcgattgattccacaagcttgcagatcactaagacttccactatttttacaaacacataccatagatgcttacagtaaatatcataaataattaaagctaagtagcctaaggacattttgtgaagcatctttgctgcttttttttaaattaggttctcgctaattcacaagattgaataatctccaaaaagcctccaaacacagccacaggccagtgctatttaagtgattctacatttttgcaaacttttaagcacatattttcttctcatgacaaaaagtaatagatattcactatgcggagctcagaaaacaaagtattaaaagtagcctgtacttctaccagctggaaatagccatcagtcatatgtaattctttagcttctcttctatgcatattttaaaaattaaactgaagtcctatagtccacagagttcctttcattccatttacatcactgttttcccacatttataaccaggaggcaggagttttaaatagctgcataagcatctaccatatggctgcaccacagtttaaatcaatcccctgtaagatttttcagatagtttccatttttcactattataaatgtctgttataagtgtctgtagcaaaaatctttatgtataaatttcctttgcacgactctcagggtttccttattacaaatggagttgtcaccagtcctgatccgggtattagacgtaagataattaaagggaaaaaaaaaaaaaaaccatcagacaaagactccgcccttgtgaagcttagattctagcaggggaaacaatcaaggataatacattttttgctaggcacaatggctcacacctataatcccagcactttgggaggccaaggtgggtggatcatctgaggtcaggagttcgagaccagcctggccaacatggtgagacccccccctccccaccccgccccatctcttaaaaaaaaaaaaaattagctgggagtgatggcgggcgcctgtagtcccagctactcaggaggctaaggcaggagagtcgcctgaaccagggaggcagggattgcagtaagctgagactgcactactgcactccagcctggacgaaacagcgagactccatctcaaaaaacaaacaaacaaacaaaaaggataatacatttttttaattgtatagtattttactagtggcatatggtatggtcagaaatgcagaggcagaacagagtgagggggtcaggaattcacggggggaaaagctacacatttaaataaaccttaaagtttcttgacacatactgccaaatgatcctccagaaagggtatactaatttttatacccaataaccagatcagggtatttgcttttttttttttttccacttagttcaaaaaaacaaaacaaaacaaaaaaagctcaaccttaccagtaatcaaatacgttaaaacaatgaggtctcatttggctcttcaaatgggcagcctagatttattcttcatgaattgtccatttgtgttctttgcccatttatctctttttatttttgtttaccacaataataactacataaaaacacgactttttttttttttttttttttttttaagtagagacaggtatcactatgttgcccaggctggtctcaaactcctgggctcaagcaatcctcccacctcagcctcccaaagtgctaggattactgtgcctggcctccatttttctctatctgtatgcatcaatctttttttttttttttttttttttttgagatggagtttcactctttcacccaggctggagcacagtggtgcaatctcggctcactgcaacctctgccttttggtttcaagccattctcctgcctcagcctcccaagtagctgggattacagatgcccaccatcacgcccagctagtagagatggggtttccccatgttggccaggctgttcttgaactcctgaccttgtgatgtgcctgcctcaacctcccaaagtgctgggattacaagtgtgggccactgcacctggctgtttcattcatttttaagagctctttatatattaaggatttaggacacactgtcaattccatgtgctctaaacaccttttcacagtttgtcatatgccttaaaattttgtgattagtgaccagcatgcacaattttttttaagtagactacatcaatcttttctattacaatttcttccccacaaggcttaggcctaatattcctcactgccctatattcagatcaatattaacctatattttcttctagctcttttgtgattttagttttacttttacctctccaactcacctggaatggatggtaacatatgctatgaaaaatggctctaacctaatttttccgccatttggctatctaactgtcctacaaccatttattgcataattttataatacgagaggcagtgaagtgcagtgatagagatcactggttttgctgtcagttacatcagtgtccaagtctggctgactttgagcctgttacttaaactccctgagcttcggtttccttcactataaaatgaactattagtaatgtattagtagtatccaattcatctggtttttatgaggattaaataagttcatataaagtcttggtctggtgcagtggctcacgtcttataatgccagcactttgggaggccaaggcgggaagataatgaggccatgagtttgagaccagcctggccaacaatggtgaaacccagtctctactaaaaatacaaaaattagctgggcatggtggcgcacacctgtagccccagttacttgagagactgaggcaggagaactgcttgagcctggcagacaaaggttacagtgagccaagatcgtgccactgcactccagcctaggtgagggaacaagactctgtctcaaaaaaagaaaaaagttggctgcgcaccatgggtcacgcctgtaatcccagcactttgggaggccgaggcgggcagattacgagaacaggagatggagaccatcctagctaacacagggaaatcccgtctctactaaaaatacaaattagccgggcgtggtggccggcgcctgtagtcccagctactcgggaggctgaggcagaagaatggcgtgaacccgggaggcagagcttgcagtgagctgagattgtgtcactgaactccagcctaggcaacagagcgagactccgtctcaaaaaaaaaaaaggtcttcagcataatgcttggcacttagaagttctgaagcgttatgtgagctgttactctgattcctctcacttaacatgaaatacaacctttaccagacacatttctatttgattccatcccactgagtgatctctatattttctaaccagtttttcccagtatatgagaaagctaattatcttttaaaatgttacgttgtaactgaactccttaattaaatttaaatgtgtcttgggccactaggaagacagtaacatctggaaataattttctttgtttctttttaaccattatttgactttggtttgtccatcctgaccagttcaataaggtaggaaaaagaaattagcaaattagtatattccatagtctccattgtgttcccagtttcagaatgttgcctctcatgattcatcactaagtctgagggtgttggctgcctgtttcttcattgagaagtcaatgcatcctctttcaagcttgagttttcaaaattctaagcagactaggaataagggtagaaaattaccaaatgcagtcaagtgtgacggctcaagcctataatcccagaattttgggaggccaacgcaggaggataacttgaggccaggagtttaagaccagcctggacaacatagtgagaccccaatctctatgaaaaaaaaaattaaagcccagcatggtggtgtgtgcctgtagtcccagctactcaaggtgatgcaggaagactgcttgagctggaggtcaaggctataatgagccatgattgcaccactgcactccagcctaagcaacaaaacaagacaaagaaagaaaagaaagaaaagaaaaaaaagaaagaaacgaaagaaaaggaaaggaaagggaggaaggaaagaggaaaggaaggaaaggaaggaaggtgatcaaatgtatctctcacacacatacacacagacagacagctgtcccttgctatatctcccatagatcccgaaaatctgaggatagtcaagtccctgatataaaacagcataatatgcacaacctcctgtatactttaaatcatcttttgattacttataacacctaatgcaatgtaaatgctatataaatatttgttaaactgtatcatttaaggaataatgacaagcaaaaaggctgtcgagtccacaggtcctttacatgttgagtaaagacccaattttttccccaaatatttttgatttgcagttgctggaatctacaaatgcagaacgggtgactatgaaggccaactatattatgtttttcttcttggctctacatacatgattatttcaagagaagacattctgatattaagccccttcttacatttccaggataaatcctatgtggttatgattcttttaaaatgctaaattcaatctgtgactgttttatctggcatttttgcatctccactcatgtcggaactcaatcttcagctttctttttgtgtaacctttgtgatggtgttggttcccagaattatgctagctttgtcaaatcaactgggatgctttacctctttttctattccctgaaacagtgtatttagcaggcaattatagcatccctctaagtttaaaataacttatcctttaaacttcttgcatccagagccctcctcataactgttttttgtttttgtttttttgagacggagtctcacattgtcgcccaggctggagtgcagtggtgcgatctcggctcactacaatctctgcctcccgggttcacgcaattctcctgcctcagcttcccgagtaactgggactacgggtgcccaccaccgcacccggctgattttttgtatctttagtagagactgggtttcactatgttggccagacaggtctcaactcctgacctcgtgatccacccgccgcggcctcccaaagtgctaggattacatacaggcgtgagccaccgcgcaaggccagaactttttttttaatgctcagcttcttccccagtttctgatttaaagtttcagacatccaagtcatttcccaacagccatgtcactgggattttcaaaggtgttgcattttaagttactgtgttttacattacaaaacaattacttcaaatgcaacttacatttgttacactttttctatcatatcaattcctttttagttttctgtatttggggttttctcttttctcttttcttaattaaacatgatagtgatttggtctacttccttggccttttttcccaaatagcttttagatttatcaattcagtgtttttatctgtttttctaattcattaatatcacttttatcttacaattcttttctccagctgtctttaggcttgttttatgctttccaagtttgagttgaatacttaattcatttattttcattttctttaataatgttttaaagctacaaatgtgcccctgaatataactttggtaataacccatacatttagatatacagagttctcaatatttcctaatgatcctgtaacagtaacttcatttcctctttgacccaagtgtgatttaggagaatatttttaaattttcaagtaactggatttcattaacatgtttaagtattctatggaggataaaaacatctctgaaaggagatgaaactctggcaaataaaaaaaaaccttttaaatagaaaacacgacaatgttaaaagtgaaaaatgactcatataatgctgtgatggccatatctacagacactccttgtagaagggatataaccaccattggtcctggggcactgagagatctgagtgtaagcaacacaaggagagagggaagaggatgttaagtctctgtgccttctgaaaattttatcttgggcatatgctgcttgcttatttcagaagcaaagtcacccctcaataaatggaataaaaccatcccagatacaccatctaagtatataaccaagtaaacttccatatttttttgatgaaatttagagatggcttcaattgagtaagacttggccccaagatgattacatctgtgactaaagaaggcaggagggaaaaacaataatctctaattctgcaatctccaagttcagaagaattgagagctacaagaaaaataaagtatatacgtgtgtgtgtgtgtgtgtgtgtgtgtgtatgtgtgtatatatatgttaaaaagcttaatgaggttccaactgggctattttgaaacctaaatgtcaggaacatgaagctgaggcagtacagtagccagttccctgtatctccttacgcagcctttcccattttacaattactacatcttgtagatcttgcctgctacagaccttaaaacgcatttcaatcccaaattaattgaattaacttgtgcttataagcatcataccgtatcaactcccttccttcccacaaactttgtagtgccaagttaaaaagaaaagaaaaaaaaatggactccataaatcagttttccaatttacgttgaagaaatctgtttcctactttctaatttctgcaactgggaaattctgtatattatgttaccatataatgaaggatgccggtaaacagaaatccacacgcctgcacacacaacagattacattgtatgtaattgcaaacaccaccaagttatgtactcttgggagcattattagtgagatgtggttatttaatgcttcatctatttaaaaaaaaaactcattccatatggatgaaaaatgagtatactagcctgaatatgggaaaaaaatagaaaatgtaatcatatattacttaaaatctataacgttttatgcaaagataaggtgttagtaccaaacttaggcattcagaatgtctcaaatacaatatcatgggctaattgctggctaccaaaacctccatcccccagcagcagatggcagggccagccttttgtactttacttgaccatttaagaaactcacaaaggggccagtcatggtggctcacacctgtaattccagcactttcagaggccgacgcaggcgaatcacttgaggtcaggagttcgagacaagcctgaccaaaatggcaaaaccccgtctctagtaaaaataaaaaaattagcagggtgtggtggcgcacgcctgtaatcccagctattcaggaggctgaggcaggagaatcatttgaactcaggaagcagaggttgcagtgagccgagattgcatcactgcactccagcctgggttacagagcgagactccctctcaaagaaaaaaaaaaaaaaaaaaactcataaaggtacacagcacctgggggcttccattagcatcagaacacccacggaggcacgccccatgggaaggtggcactcagctcccaccacagagcaaggccctttaacagcgaagatgctgcagggcactgctactcgccctgctggggagaagccacccagcagccaccctaggagcctggcacagaatgcccagctgtggggaaggaaactgtgccacctgcatcgcccgtgtgccaaatggagttcaagactctgcaccgttccccattcatccccacgagaggttcagcagccactgccgctaaaacaaaagacggatgacaggaaaacccgctggcctttggcccattccctagcaaaggggaagtgtaaaagtgcaaaggggaaagtgggccagctgcactaatccctctttgtccagcagtaattaatagtataatccacatttcagatgcattaaagcgaaaatgctgcattatcagagagcccggcacacagcctcagggcagagcctccctgctgacctgcagaaccaggttacctcatctcagcctcctcctctcaggggagctgactctagacacctcataaaaggaccgagctggcagccagaagtctccactctgcctgatgtgctgtgtctgtcttcagaaaccacccactccagagccagtcctttgggcacacgagttctactccaggagacatttacatcaagttctactctctgaccaacattgaacattttatttttattttatttttttacacagagacagagtcttgctctgtcacccaggctggagtgcactggcatggtcatagttcactgcagcctcgaactcctgggctcaagtgatcctcccaagtctacctcccgagtagctaggactacaggtgtgcaccaccgcactgggttaattttttgtttgttttattttgtgagacagggtctcactcttgtcatccaggctggactggagtacagtggcgtgatcttggctcactgcaacctcgacctcccgggtttaagcgattctcccacctcagcctccccagtagctgggactacaggcatgcaccaccacaccgggctaatttttgtattttttggtagagacggggtttcaccacgttggccaggctggtctcaaactcctgacctcaggtcgatccgcctgcctcagcctcccaatgtgctgggattacagacctgaaccacttcacctggccctggctaatttttttttttttaattttttgtagatatggggtttccctttgttgcccagcgtggtctcaaactcctggcctcaagcaatcttcctaccttgaactcccaaagcactaggattacaggcgtgagccaccacacccagcaacactgcatatattaatatcacaagtctgggctgggcgtggtggctcatacctgtaatcccagtactttgggaggccaaggtgggcagatcacgaggtcaagagatcaagaccatcctggccaacatggtgaaaccctgtctctactaaaaatacaaaaattagctgggcttggtggcgctactcaggaggctgaggcaggagaatcacttgaacctagaggcagaggtcgcagtgcatggatatcatgccactgcattccaggctagtgacagagcaagactcaatctcaaggaaaaaaaaaaaatcacaagcccccctgtggattcttaagctttaagctaactcccctccccccaaaatactgggataataaatgcaaccaaaattaagatgcccctcctcaactcaattcggtgggatacctttttttatcttggtgttatttgggtattctgcactaattctggggcaccaggtaagtttctatcgaggggtagaagctgacttctgtccccgtcccccaagaccaaagaggaagcctcttctgccaccactgaaatactatctttagaggaaggcatgctattagctcatcaagcacaaaacacattcgagctaaacattacagtcaaatgtcacagccacttcaaaatagaggtacccaaaaaggcagtcagtcttctcagcagggctttgaaaccactgccaactgagaacttgatctcaagtcttccaacaccaaaacacctggtggaataggtacaactaacgggcagacagcctcaaactccattcagctccacagcgcctctccatgaccactgcagctcaacctctgtgctgggaagtgcatgcataggatggagccatgtttctagaaccatcagagacaaattttctactacaagtgatactgcacatgacagtttattccttggctggcctctgatagtatgcatttgaaccatatggaatcaccattttttttattaaattagagctgttaaataataacatcatggaggaatgtgttaggttctgggcaaggatcttaaatacacagttttggaacaagtgtagggaggggcccaagcccacggccggtgcccaacggtggctacacactacagcagcaaccggccttcatcctccaagtcctccttggaatttgggtgaaactacttatatcttaatctaggcagctggagatgaagacaaagacaaaagagaagaggagagaaaaggaaaataatttgatagaagtattttccatcccaaattttgagatcctggcacgaatgatataatctagatacccaacaacctatacttgttccaaaatcgtgctgttaagatccttgcccagaacctaacacgttcttccatgatgttattaacaactctaatttaatccaaaaatggtgattccatatggttcaaatacatagtatcagaggccagccaaggaatgaattgtcatttgcaatatctcttgtagcagaaaatgtatccatgctggttctagaaacatagctccatcctatgcacacacttcccccaggactcctggactgccaaaggcagcctataagccatcaactagcaactggacatttcatctgggcgctcaggaggtacagacctaccaatcacgggagtgaaggtacccaggccaaggggctgtacaagaagggcagagaggaggccaccatcctgaacacatcacagactgcccatctgtgcccttcaagtgacctctaaagtgtggtatcaatctccactgaacctttgctcttattcccacaacacttggattctttctttacagggacccatgtgaaaactctttatttttttattattattatttttgagacagggtcttgctctgtcgcccaggttggagtgcagtagtacgatgttggctcactgcaacctctgcctccctggctcaagcgatcctcccacctcagcctcccaagtaactgggaccacaggcgtgtgccaccacacccagctaatttttctattttttgtggagacagggttttgccatgttgcccaggctggtctcaaacttccaggctcaagtgatctgcctgccttggcctcccaaagtgctgggagtacaggcctgaaccacggtgcctggccaaaaaccctttataaacactctcttttatttttctctcaagtatgactctttgggcctcaccaaaatacaatttcacaaaataatgtcacattatttgggggaggggagaggccaccaaatttcatctcgaagcctcttccctcatttccaaggaaataggcattgttggaacaggtaaggctgtaatatttggtttagctttgccctcctgagccacctacctctagaggcacgtgggggtctctttctttgccaactgcaccaattcctccacaggaccgtgcagtagctgaataacaacccccgaagacgcccacatcctaatatccgtaacctacaaatatgttaccttctacagcaaaggaaactttgcagatgcgatcaagtgaaggatctttggatagaggagatgatcgtggattatccagggggcctgatgcaatcacaggggtccttacaacaggggcaaaggagaggacagagtcaggcagaagaaggagatgtaacagaagcatgacacagagtgatgtgaggaaggggccatcaacccagaaatgtgggggcctccagaacctagaccatgcaaggaaatgggttcctcctcgaaaccgctacgagaaagcagccctgccaacaccctgacttcagcctactgaaactgatttcagacttctaggctccagctacaaggcaatcagtttgcggttttttgcatttttttttttttttggaaaaatgaaagctgatttttattttatcatcaacagccattctttagacatgaacatgcatacgtaatattctatgcacacatcgcagttttgaacattagttaataaagtttaaacatactacatccttacagaaaacatcaaaatgcaaacttaagtttgtgttttacaccaacaagtttgtggtaatttcttcttcttttttttttttttttttttttttttttgagacacagtctcgctctgtcaccaggctggagtgcagtggtgcgatcttaactcactgcaacctccgactccctgcttcaagcgattctctgcctcagcctcctgagtagctgggattacaggcaggcaccaccatgcccggctaatttttgtatttttagtagagaaggggtttcaccatgtcttgatctcctgacctcatgatccacctgcctcggcctcccaaagtgctgggattacaggcatgagccaccatgtccggcctatgtggtaacttcttacggcatcaagaggaaactagtatagccatctggagaaagggggacagaaccactggacacacagaagcaggggtgtccctgaagggttcaccctaccaaggggttcacactaccctccttctccagaccctagggaccagctgaaacctctctttctccatcaccaaaaattaggaccaaaggcctcagatgctgtaatcaagagctgtgtcttttttttttttttttttttttttgagatagggtctcactctgtctctcaagctggagtgcagtggtgcaatctcaactcactgtaccctctacctcccgggctgaagtgatcctcccacctcagcctcctgagtagctgggactacagacgcctaccaccgtgcacagctagcttttgtatttcttgtagagacagggttttgctgtgttgcccaggttggtctctaactcctgggttcaagtgatccacccacttcagcctccataagtgctgggattacaggcgtgagccaccacaccggccacgagggctatgtcttaggagaggtgttcagtggagtatcttagcattagacagaaaaaacctcccatcctggcctaccgcatttgagatttataaatatccaaattaaccaaggaaacaacagaaaaacagtagttggacaaagagtttgtgtgtgctacatgtttattttatctaataggagacaccgaactagaaacatctacattcaagaagaatccctggatccacagttccttttatcaattcacaaaagccaggccgagccaaccttacccaatatattccacaggtgggcccgcctgaagcctcgctgtgatgccaggcagccagcctgaagaactggaaagccagggcccgtgcacgctgggctcctgaagacaaaggaaacagaatggctcgggaaggccgtggcaccctgcccgcctccgtggtagcctggggccactggatcttgctgtctccgcagcacctgagaggtgtgagccaggcagccaaccacatcagaagctggctgccggctgccccaattgcacaacacctccaggggagccagctttccaggactgggttttacacaccatacgggcactggccatgttgacccagtcaaggcatggcaccttgaagaatggcccacgcaaagaccggccatatggacagaaggcatcctgccacagagcgatttctgaatcacctctatgcaaagaatagtcttctctcttacgcaaaggagatcccatcaccaccatctcatttctatcccaggctcctccagttctctttcaatcacaagccagactacccaaccacttaactctctaggcccagatatgacttaattctcccactcctgcatgtttgttgccacttccccattttgtgttaacaattaacctgaagtattatgttaacaattaacatgaattgtgttttggtttttaaggtcggagtaactaggattactcaataggatttaaatgttcaattttagcacacatgtacaaggcgctactttgtacatgacaagatgaagtggtttaaaaaaaaaacaaaacataaccacctttcacaaagggttctcattcagcctcctgcttgtgaaagatacgactttgaatagtgaaagtcccaagaagggtaattcaagcaaaactggtttctagtttgccttgattcaaattctttatgctacttgacccatttctcttttcctcttgcttctcctgatgcctctcaaaataataataaaccaaccccagaaatagaatcctgtcttccttagatgtcaccatatgactaatttatggcctttgtttaaagcccttacaccagagttgactccagtaatttcctcctcttctatttgaatgtccatttacagcctctctgtaacctctgggtgaactgagaatgttctctgtgcctctcatgatgtggattcgcaccctggtgacagcagagtggctccgagcagaatctccccattacagctgaagcccactgggaccctacccaagttcacgtgtatatcccaagagagtttgctgaacactccttatgccttaatgcacctttgaaaaaaaaaagactaagggggctgggcgcagtggttcatgcctataatcccagcactttgggaggccaaggtggaaggttcacttgagcccaagatttcaagaccagactaggcaatatggcaagacctcatctctacaaaaataaaaataaatcagccaggcgtgggggcatgtgcctgtggttccagctgcttgggggtgctgaggcaggaagatcacctccctcagccttgggaggttgaggctgcatggagctgtgattgtgccactgcaatccagactgagcaacactgcaagactcccatctcgaaaaaaaaaaaaaaggcaaaaagatatcaaaggctgagtgggcaatttgaatgtgttcccaagacgtgatgggaattttctacgtttggattcaggggagtggggtcttagttttgctctcattcagggaggtgggtcccaaaaaatatcccctgttggccttaggaggaggaatacttgaaaggtatatctgaaaatgctccaagttttttcctgccccgctttccagtggtgcccttcgccaagtcatgaaaactctgccaacactgttctctctccagcactcacctgggctccccaccaatgtcttggctgccgtcacgactaaataatgccttctcttcttcccctccacccacccctctctggtctttagcacaacctatcagctgacttctccaactccagggagctagaccacatagtcctccaccaagagctttgctagcttagcaccccacagatagagctcgtccagagaattgtccaaccatccattaaaatatccaagtggccccagtgtgccagagactgctctctctggactagggctaggggtaagcagcaaaccaaacaggctaagacctctgccacctgcatagagcccatgcctactgtctgacccatccctacctctgcagatgctccttaattccccacttttactctctcctcttcagaaaatgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttcccaggctcaagcaatcctcccgccttagcctcttgagtagctgggactacaggcatgcgccatcacacccggctaattttgcttgattttttttttatagagacagggtctcactatgttgcccaggctggtctcgaactcctgggctcaagcaatcctcctgccttggcctcccaaagtgctgggatgacaggcgtgagcatacacgcctggccatggttttgatcttataaaataaattaactctaaggccgggtgtggtggctcacgcctgtcatcccaacactttgggaggctgaacggggtagatcatgaggtcaagagatcgagaccatcctggccaacatggtgaaaccccgtctctactaaaaccacaaaaaattacctgggcattagcctgtagtcccagctacttgggaggctgaggcaggaggatcgcttgaacccaggaggcagagactgcagtgagccaaaatcacaccactgcactccagcctggcgacagagtgagactccatctcaaaaataaaataaaataaaataactctaaataataaatggcaagaattttctttaattggcattttgtggggattcaccccaggcttggctgtgtgttatcatactctcttcactctgagaatctgaactgtctccctgaaggactgaagctagcctctgtatagtctaaatgctaaaactggctgtcagtttcctcaatgcttgccactgtgattttattctgaaagctacagctcttctcattcaaaggttaccctccctcctaaccaacccagaaagaactcactacccagctctgcttgcaccctagtgttggggctcaagcttccggttccgctaagactctgacctcgcttctaaggacacacacctcagaggcccagagctccgctgtatcacacactcattgtcacatccctcgatgcatcattcccagaatcctcaaggctgtcactggatgaaagaataaaacagcaaaacatccggcaccttttcatcctggctcaagtcaaaagagttgggattaaagccacttgtgactttcaaaagctatcactacgaggcaaggaccgagtggccagttcgtttcagaaagtggcctgatgctgttgaaactgccagctgccagtggacgtgagcctcactcccactttatagtctcaggaaggtggctctcaggacatgacgccaagccccagaagggcctctgaatcctccaccagcgtgtgcgtgtgtgtgtctgtgcgtgtgtgtgtgtgtgtgtgtgtgtgcgtgtgcgtgtgcgtgtctgcacgcgcacctgagtgcacatgggctgcctggtttacaggccaccacaacccttccaccaagtgtgaacacacatacacttccttaccaaggtgcccaccggaaacccctgcctggacccctgcagccctcccagccacactgcagcatcgagggaacagcactttgcctccccaaacctgccctggctactgggtgaccccgctctgctatccccaccttcaccctgagatgcacagactgtctgctctaaagggcatgaacctggagattgtgagtcatcacgacgcgcaggaagcaacgtctcagtccaaaccctgagcccgttcctagagagccttctccgctctctcacccctcatcccacgtagagcaatcagggctcacccgcccccttccctttctctatggcttcttcaagatctcctcatccatctgcccacaactggaactgtttatttgtttagcccactggtaagaaaaatgagagagcgggctggcattcctggctgggcataaacacgtttttaaaaaatgtctgttccaactctgtctgggtcccgtactgagccctttaacctcctgcaagcaccatggagacattccatgggaactatcaccattcgttatcatcgctgaaagacaaaatccactgtaccctgcaacatctcacacagatccttcacattcttggtttgagagctgactatgcaagaaaaaggaagcaccatgactgtgggaaaggccactgtcaccaggacaagaggcaccagcaagagccctgcatcaattactctacagaggcaccgggaggcctgattttaattttttaaaaatacatttaatgaatcacatacgcaaactttacattggcagaacactcccttaggatcatgagcaaatttctgatcagatcaaatagcaaactgcccaaggaaaccacgaagaggggtgatgttgctatcacactatcaaaaagtaaagacatacttctgatttctcacaagaaatttcccaacaaaagctctctgtcttagattccgaaagaaaaacatcccccacacagagtgtaagggccaagaatggcctcaccatatgggacagcttctgaaatacacagaaaacgggcaacgcgggacccatgggacaaaccactgtgtagccagctgccccggccaggcccgtggtgttgactttggcagtgcttgtcgaccatgactcagcaatagtcatcgaaactgaaatcaagtggaactgatcagttcagacctccaatgttgagtttgactcaacgattcttcaatgcccctggtcttcctgaaattctccatttaaatatttactggtttaagggtaaagtcagggaggcacgggcatggttgttggaccttttctgtcttatcctattcaaatctggctgaactgagtaaaacgttatgcagcaggatgtcttcctatataatccacttcatcccgcccccccaatactcttccataggggttcaaatgcagatctgaaccaactgctcgatgatcccccaaagccatttagtctctgagcttttctcatctacaaaatgagatgtgtccccactctgcataccgtatagagcacctgcaaggattagttgaaagggtataggcccaaggactttgaaaaatgaagctccttaaattattttcccgatgtcctcagacagacttggcaccttacccttttactcataattaaagatttgagcagctaactcagaggcctaattgtgatgctaagtagacatatagtggctcaataaaaggaaagactgaaggggtttagagcagcgaggaaagacaatcgaggaaacggggctcgaggttctgggacgagggcctgctgagctggccagcccagccaaggccacagggatacagtccttccagtcactcaagttaaaaatcttgcagtcacccttgactctatgtcctgtcttgtcccatatctcccttcaaaatctatccagaggataagcacctggagcagatcgaatagcatccctcctagaactcatgtctaccaagaacctcagaacatggccttatttggaaatagagtctttgaagtaatttataactaaattgagctcagactagatcggggtaggccttaaatcaatgactgagccaggtgtggtggctcacacctataataccatcactttgggaggctgaggtgggtagatcacctgaggtcaggagtttgagaccagcctggccaacatagtgaaaccctgtctctactaaaaatacaaaaattagccaggtgtggtggcgggcacctataatcccggctactcaggaggctgaggcaggagaatcacttgaacctgggaggtggaggttgcagtgagccaagatcatgccactgcactccagcctgggtgacaaagcgagactccatctcaaaaaaaaaaaaaaaaaaaaaaatcaatgactggtacccttagaagaggagggaacacacagaaatgcacacaaggaagacagccacgtgtagacgggaggcagaggctggagtgacacagctccaagctaaggaatgagtctttactcaaatgtcaccttctccgaaagcctttcttcactgtgtccaccgaacctgccaactactgctcaccccctgccctcgtcccgcctcctctccacagcatttaacatcatccaaaatactataatgcacttagtaatgatgtccagtgagggagatgaggtagtataagctccaagcagacaagcatttctctctttttttgcccccattggagtatcaccggcaccaacaacagtgtctggcacacatgggactctcaaacaaaaggtcaagggcagcccagggaagccccaaggctggaagctctcgctgagaaagccaggctgggagaagcccgtctccctgagtcaggcctgcaagccaggcaggcagatggtgaaaggcaggagggagaggagccactgcaggcccctggtcagcagaacaagaagaatacggagccgggagtttgagggcagcaccactgatattcaggctgtgtcattcttcgttggggatgagggtggctgtcctgggcatcgcaggatgtttaggagcatccctggcctctacactggatgccagtagcatcctctccccaaagtgtgacaaccaagaatgtctccagactgccaaatcttggggggaggaagcaaaatcaccccctacggagaaccgctgaaactgagtttcagtccaatgacggcccacatgccacgatcccagacagcacagggccaagcaggtaacacaaatgagcgaagttggctgggaaacaggacgtggtagggtaagagctggtaagcaacagtgagctctggcaacctaaaaagtagatgttccttccacaaggggcagtcaccaccctgttctagccaggttttgccctgaagacccaaaatggccaaatcccccgattttttttttcaagagaaggttttaatactgatttttctgtgaaatgtgcccatgtttaaaacatagtatgtggccaggtgcagtgtctcacgcctgtaatcccagcactctggaaggccgaggcgggcagatcacttgaggtcaggagttcgaggccaacctggccaacatggcaaaaccccatctctactaaaaataaaaaattagcctggcgtggtggcccatgcctatgattccagctactcaggagcctcaggcaggagaatcgcttgaacctcggaggcagaggctgcagtgagctgagatcgcactgctgcactccagcctggcgacagagcaagactctgtctcaagaataaataaataaataaaataaaatatagtatttgctgaacaaaacacatctacaggctaggttttgcctacaagctaagactgtgcaacctccgcacagagactgcctggaggtggaaggggctggagggaaaccccccttaggagcctgctgtcatctagacacaaggggcctggagcaggcctgtgagggtaaggggcggagggaggaaaggctggatcccagaaactcttaaggtgaataagataagcacagcaagacaagtgtgcacactgtaatcataagccacgagggccaaagcaacagccaatgcccccggctccctcccacgatgcgctacaggcagcactgtgcttacgcaggtcacacacctaggagccggaagacccctaatgcatccttcaggtaggaccctctgctttgcagaaaaccagcgcttagaaaaggcttaaagtgagtattttgaagacggctggaatcagagctcaaatccataacctcaaaggcttcatgtcatcttgccaccacccacgccaatccttgagcctagagtaacgaagagaaaggctgcaacgaccacacacaccacgacgtcagcccaaaggccacgtggctccatccacggcaacaaaatgcaagggagctccgagggacacttccgtttcaggacaggcttacggggaggacaccagctcctcccaccctatctgtagactgggtagaagggcttcttttgagcgctctgtcttcccagagaaggacgtcctggaaacaaggcacgtgcagtattaccattaaacaacatgcacatgccagtggcgctaaataaacagcagagacagaggctgcctcacccacttgctccatagtctgcatcgaatcaaggtcactggagacaaggtaaagtccacagagccccctcatctcacatccacacagctttgctcctcctgaaagaaatgaaatagctggagtgttttggcaaagaaacgaagaggcaggtgagcaaggagagatgggggaagggaggggcgaaagaagagaagaggcagccccatctcccagctggggagaaacttccagatgggaggcagcagacgccactgaattgatggccagtctccaccaagcctcatcatgccccgcaggcaaagtctccactccccttccttcccccagccacgggcaggaggcaccacccatgaagactgagtctgagatcatgcaccattgactacccaagcccaattcttcctgtccctgatctccaagtggtagctgcaaataagcccacgtgagttgcactgaaaggatcagggcactggttctcgaggactgggaatgcaatgataaaacgaaatctcaccagcactcagtaaagccagatccaatggcagccttgggctggtcacccctaaaccgccatgtgtcagtcgggttccgcctcccagaagcgggttaccctgatttgtgagctgattattctagaagactccagggtctgaaagtatctcaacaggttggctatgtaaaaacacagtcaatcaagcagccagacactttgcagagagactccactccacgaagaattacaggaggaccagagggtctggctgtgccggatcccacagctcagcggctacatgtcccccagaaggtgggcccaggaaggccctgcaccttgtatgggaagctctctactccccaacacaatacccctcggccttgactgccccttagacaccgcctgcctcctggagacgagacattcctcagccctctcccacatatgatctccgcatgtatccattataaggatctaacttttttatggagaggagaaagttcccacatgcagaagacttacaccgcagggggaacgaagggagggtcatttagcacttgttgaaagaagatgagtatgagagcaattgggaggagaagaaaatgtcatgtcagctatgaaagttaaacaggaacgttcccctccccacaacgaccgccctgcaccgccctgccccaagtccttcccaatgcggcggcagccaccagcccatgcaggactcacacatgggcagacacccaagttaagagagggggcccgggaaggggagggacaccatggtggtttgcagagctccacctctgggaatggatttgatgtcaagtgtcagcaagtaaattgctattggcttctcaataagcagcagcagtgagttaagtgtttccccgtattgtggagccctcacggactcgatacagcagtattgacagcacaatcacacagtaatccagggtcctctaatgcctacacttcctcaatgaaaatacactttccacttggacatcagcccattagctttgggctggaatctctggcctccttatccctcccccaggcacccctgggctgcaggtctggcatctggccccctgacaccccagccaacatgaacatcccagccagagtattgtcagggcccaaccgaaaaagataaacagtcagagacctacaggaaaaggcctgctctccctgtctataaatcactggtgggaaggaaagaaaagtgatccaactctttcaggataaaaatcacagcagtcactgaggaaaattgatgttcccttgcaaagcgaaagatgttctctccgggaagatgcatgccttcaagttttcagacagactgagactcaaacttcacccaatgtgacacaggattgagacaagttatgtgacctccacaaagctcaacctctcacgccagattcgatgcttcccaaaaggaacacacccatgtcttggcagtctccgataggctgaaatagtagagggtctgctgggcacagtggctcacgcttgtaatccgagcacttagggaagcagaggtgggtggatcccatgaggtcaggagttcgagaatagcctggccaacatggcaaaaccccatctctacaaaaaatacaaaaaaaaaaaaaaaaaaaaaaaaaaaaaagccaggtgtggtggcaggcgcctgtaatcccagcaacttgggagggaggctgaggcaggagaactgcttgaacccaggaggcggaggttgcagtgagccgagatcacaccactgcactccaggctggggggcagagcaagactctgtctcaaaaacaaaaacagaaaggccagtcatagtggctcacgcctgtaatcccaacactttgggaggccaaggcgggtggatcacctgaggttaggagttcgagaccagcctgaccaacatggtgaaaccctgtctctactaaatacaaaaaattagctaggcatggtggcaggcacctgtaatcccagctacttggaaggctgaggcaggagaactacttgaacctgggaggtggaggttgcagtgagccgagattgtgccatgccattgcactctagcccggcaacaagagcaaaactgcctcaaaaaaaaaaaaaaaaaaaaaacacatagtaaagggtctgctcatttaatagtaaacactttgcaaatgcaagctatgtttcaaaaccatttctcatccatttttatttgactcccagcacaccctggaatcgctgggggagaagattttattccagagaccagtgaaacacaggtaaaggagaactaacgtgacttacccaaggtcacacagctagttagcagtagatttggagctagagcctagactagggttggcaaacttttcccataaagagccatgtaactatttcaggccttgcaggccacgcattctcactgcaactactcacctacaccacatgatagcatgaaagtggtcacagacaaaacacaaacaagcaagtgctgctgtttgccaatgaacatttaggaacacaaatataaatgtcacatattgtcagatgtcccataatcgtattcatcttctgattctccaccagccatttacaaatgtaaaagccattcttggttggcaggccatgccaacatgtgttgggtcggaactggcccgcagactagagtttgccaatcccagattgctgggagacttctcaatatctactaatagaataccacaaagccaaaaaaagacaaaccgtgatcattcccaggcttattacaattttaactctccagtccagtcaaaattgcttgcctagcaaacaccaaacgtaacccaggctccaggtatctgacagcaatacagcttgcgcatgcaggcggggtgttcaaacttctctagaaaacaatgcctttttatgggaatgcctttttatgggaatttttgcacaaaatttcaagttaagaaactttccataaatacacaacgcatgctctagccacagctggtttcatatgctaactgcagaaggcatttccgaaagcagcatgtgaagagtcctccttaaatacagcgttagggaaaatgacaccctctatcctccccactgcccccaccaccaagaaggaatttgggtctgtgttcagtaagaagaaatctggccagaaaggggttaatgcccttccaggctgggatctgataaatggctgtgcagaaagcaggttccctcactttgagatatgatgtcactaacctttattgatccactatcagagaactttgcttatctctctcctgtgatatactgcccctcctgtgctcaactagtgtttaatacactgccgggtgccttgcactcctcatcgctcagcactgcagagagaggctgccacggggaccatatttcacagagccgggccttcccagcacagacgcctcccagagtcaaggggagccagcacccacctcccacctcctcccaggccgccaggtcccagctgcaccgagacagtgggtcgggtcagggcagggcaggataggacacggcccctccgggaccctgcggcttctcctttttttgggggagtgtggggacagagcttcagtcccaagattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggcttcagcctcgacaggtgtgaacaagatttcaacacctcctacaatacaatgcaatccaaacaaaggggaaagtcaatcccagcctcctgaggtttctgcttgtctaacatcttcttcactcactcagcccaggggagccaagtgcaccttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccaatgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccattctactgcagccagaattcctagccttggcttctttcttaccaatccataaaaagatttctttttaggtaaataggatatttatctcagcatcccaatactcccaagaggtcacaaggatctatcagactaacaatggcacttggtctcaagaagcgtaaagaaaacgaactcaagttctataaatcatcacaaatgttttcacaaataattaatcttcgtttgaaaatgttttgaaatatcccaggtagccgaccaaaaaagcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatcgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggggtgaaggcactgagatttcagagggaaggcagcaccccaatagaatgcacattctagaaccttataagagtaagtggcctggcattgcctcaaaactttatgagctcctgagagcccctaaagaaaaaaaaaatgtgtcctactctagtagggagaaaataagaagatgtgttaaaactggccaaataggctgggcgcagtggctcacgcctgtaattgcagcactttgggatgccgaggagacagggagatcctgtctctacaaaaaattaaaaaattagccagacgtggtgatgcatgcctacagtccgagctactcgggttgcgggactgaggtgggaggatcgcttgagcccaggagatggaggttgtagtgaaccatgattgtatcactacactccagcctgggcgactgaacaagaccctgtctcaaaaaacacaaacaaaagcaaaacaaaaaaacaaaaacaaaaacctggctaaagaccctttcctagtgaccacagtcatacaaggcatccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttcttttcctcctcctccccccagcaggttaaagacctgctagttagcaacgagagcggatggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcaggagcaggatggggaaggaagaaggtagatgcatggaaaacagaagccaggctctcatcccaacccactcaagtttctccccaagcctgggccctccttgaccccacgcgacaggggagcagcccttccaggcctgagctccaccaccctccatggacaggtgacctcagctgccagacacctccttaccccctacccccagtaccctggagccctgccagcacccccacataacccaccaatgacctggagaggaggacagaagaggaacggccttgcaaagcacctggagaaaaaggggttaaatgcccagtgtctgactgagggagaaacttcccctcccttccaggcgcctccgagggttcgtcctcaactactattgttattcaagaactgcgtcttagctgagcagctcccccgccgccccccagcactgggtcttgacagaagtgaagcggggctgcctggtgtcccagcacagggcctgatcatatcctctaaaacgtgaacagtttcaacttgactggggggaaagggggcaggcggggggtggggggggactggcactccttttaaatgcagatttgaacttttcacccggggtcagacagctgcgatgctctgtccccagcagaggccagcgccggggccccttccacctcacactttcacagtttttttcctgcctgccaggaggccagcctgttaaaggaattcgatacctccctccctccaaacccaaatccacacccgcttctcagcttaccaggggcacaaatcccactggcatcctagaggagagcctcaaatcgtaggaggctggctgggtgctctgggaacagcaatggcaaaggaaaattgttgttgtcacatgtattgaccaaggaacgctaaggtcaacagtgagaagactccaggacttcccggccgctctgaaagcatctgaaagcagcatcttctctagggtacatttcacagtggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattccgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacagtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctacaatgtactggctcccaaatgatacttttaaatgggctgaacaatcttagtatccaacaactcactgccaaactcaagtataaactaagaaaaaataaatcacttctgggacccacagcgtgcttttaaaaaataataataggccaggcattgtggctcacacctgtaatcctagcactttgggaggccgaggcaggtggatcacttgagctcaggagttcgagactagcctggccaacatggcaaaaccccgtctctactaaaaatacaaaacaaaacaaaaattagccgggcatggtggaaaaccagcccacgctggtagtcccagctactcgggaggctgaggcaggaggactacttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgccgctttgtggggggaaaaggagtttaggaagaaagggatgggtggggggatgtatttctccctggtctgtccacccaaagctctatgatacgcttccacttctgtgagagtcagaaagtggaaataactcctgctcagcttctaaagagggggaggttgaaaaggcgcagggaggaggagggaggtggaggtagagggtagaggaagaggaggggagaggggccggcaggagagagggaggagggggactgggtgtatcaggggaactgcccctcccggcgctttgatcccctcggtcggtcgctaggagaaaccaacttttctccttgggttaatcaaaaccaaattactcaggaatgtggcaggacaggtctgaacttccaggtccctttgtctttgaggatttaaaatgaaaaaaaataaaattgttaaagcagatggccgtggcctactcaagaggtgaagcgaagagtctgagggaagtcagaccacatctctcaccctccaaaaaaacacacccgcaaacttcctatgccaatttattgtgagagaagttatttttgtagacaacatccaaaaatcagaagaactgcccatttcatccttactgctgcgcaaataaaagaccctcaccccaccctcccatcaactataccttgtcaaagtacaaatacaagagaaccccagatttaagatacacccgtatatcacaacccgactattaaaagcggagtccaaactagctcaagaacatacgttttccaaacacaaagtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagatatgaaatgtcccactgagtgacataagatcccactgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcggaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccggggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggcagccaatatccggagaagcttttcagtatgtgaagtggtatgaagccctgattcctatttcatttacttcccactacaaatgtaaggtatgcattaggcccattttacagacgaaagaagtgaggcccaaagaggttaaattactggtccaaagtcacacagctcaggcctcaccagagggtgtaacactgatggcctcagcagagggtgtaaggcccatagcagaggaaagagcagaggccacctttccaaagagtgggcttttttgattcacctttgcttctcccattcactgttgagtccccatttgaaggggattcacaagcagtgctctggtcctcagccagaccctgccctgttttattctgtaattatttcctaccttcaaacaaacaatgaggaagaccacacctccctccagttacacatctgggagtccgcaccaggatttcctctgtcacccaatttttccactgtctggacaatttttatagtttcaccagcaagggcaaaatatattgacagtcctttcccacaaggtgtaaaagttctctgctttccccaaatatacctctggatttcctatctgttgaaggaaaaaccagcttcgactgcctccgttaaaaaagggtgtgcagggctgaggtgaccctactaccgtcatttctgccattctttacttgaacaacattttttaagtgggcaaaatactatcttatgaaaaacaaaccaacaggggcccaggtaacacacattcatatagtcagttacacagactgaaagtcttcatcaatgcccatctcaattacgttatcaaataacataaggggacactattcaagattccatcagaacagagatggcatttaaaagcagtcgcttgagtagtgacaccaacctcctgccgcacacactgaaatccatgagcctcttctaaagtgtccaaaagttgacctgacactttaacgctgatgcagatactccacaaaaaaaagcggagctgttaaaagggaagcagaaaccattcctccagtcaaggccaaatgtacattaagaaccaaggccttgagccaaagagcattttaggaagcagggccttaaatggtggaagaggcttgcattgcttcttgagtagttaagaacaattgtttaaaaaaagaaaaaagagaagttgggagatggagaagaaaggcacccatgtgttcttcagcaacttccacgggacaaagatgttgggaagggagaagtcatcagaaataggccactcaggagactggaagcatggggagcagctcagttcatgtctacacatatgtggtttttatagactttcaggagtttaaatgcttctgaaaagcgatgtttgcatactgaagggagacagacttccatatttgaacaggcacttatatgactttttcaggggatgcagggctgagatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgtggccaagataacttttgggacagtggatgaaatcagcagcagatgaaaactccacagcctttttcagagtccagtggagccagttctcccacttccagtccaagtctccctgcagatgactgaaggtgatccatacattcctaactgctgccccgaaagacccacttacaattaaactccaggtcaccagttaagaaagcctttaggccccttatgtcattagcttcctcccagaaaccaagcagaatagaaagtgagaggcatcccagcaccggcccatcttctcaaggtgtggccttgcaagggagtttcagtggcttcatcccaaaccaccagcagccaggagtaggggtgggagtgcggcagatgttttgcccgcctcactggaagctttagacctgactccagggagggaaaaggatggacaaatctcagaggcagcacatgtgttaataccaaagctcaaagaacacacagcagaaccacctaagacctccaggacacagcaagccagctaaggcccctctggaaaggtacacatcaaaccccccacacagtaatcctcatgttgagactgctgtggtgaccctctgatggacagggagagggggtcacccaaaaggcagatgaagcccaggcattttgctaagaggcccgggctggagttaaaaccaacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcgtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggttactgacaggcatcttcagtgtgcagtacgagtgagggtgagatggagtttatataagtttgttcagaccagaatcattgctgcctacttgtaagtcaaggctaaatccttagagctgagaaacaagtgagttactcttaaaaggtgagtgtttgtttgtttgtttgtttgtttgctttgagatggagtttcggagtttcgctcttgttgcccaggctagaatgcaatggcccaatctcagctcactgcaacctccccctcccagattcaagcgattctcctgcctcggcctcctgagtagctggagttacaggaatgcaccatcacactcggctaattttgtatttttagtagagacggggtttctccatgttgatcaggctggtctcgaactcccaacctcaagtgatctgcctgcctcagcctcccaaagtgctgggattacaggcatgagccaccatgcctggccaaaaggtgagttttataaagacagctcactttcttcccctttaaataattcaagccagttccctacacttttacaaaatgttgcttagtcacttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccaaagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcaggtggttggggaagcagcatggatttacattattattattattattattattattattattattattattattgaatagttagcaagtgtttctcaatagttccctgttcatcaacactgttttcaggagaaatggaaaacagtagctctatttcatagaaagtacagccatttcaaaaaaaaaaaaaaaagtgggggggggttgttgagagagggaagtgacccatgtcataaagacagaaggtctccaagtcacttaattccttgtgattctgaaagggctgtttttaaagtctaaaagtgctcgcttctgcatctgctccatgttgttaaataacacttgtgtaattaaataaaagagccaactgtgaccccagcccactctgagaggcactttacatgctttctgaaaactatgctggaaacaccatgaggagaactccttagtcctgtaatttagcaaagggagagagaaaaagtttcttttggccatcatagctacacactctctgaaagggtgcctgcagggtctctgcaaaacagaatgaacacaaatacaggcgtgcaaacatccaggtatgtacctctctgtgaagaccccattcttgaaacccttcaattatttggaaccgtggtctcctgacttccctcacacctcacttttgccttcattgtttttcatgtttgagtagcaagagggattcagaatctcaggctgccagtggctgttctgataacaaggagcagactcatgtttcttgctacggcctttcttgatcaggttaccttggaaggtgtatgttttcctacccaatgcagtccccaccacagcactctcgtgtcctcctccagcccagcctcctggaactcgtgattttcagggtttcccttgaaacctatccagaaaccacagccattaactgaacgtgaagatttgacacctcctgaattcaggaatgagggaactcgaggggccaactctacaaactcgcacctgctgcttgacggcaaggaaacagagtttccccagctagggtgagctttaaattatacactatttatttagtgacttgtctccaaggatctcaaagcatagagagaaataagatgatgtgtaactttctcacaatctaccttcaaggctttgccctggtgcattctgacaagcaggacccagtatgaaggagaggccttccttctgtgcccaggcagagccatctgttctctctggggttttctgtcagtggctttagggagtcttcaaggactgttaaatgacacagagggtggggggagggatgaccctcctggattcacctgctcacggctttcacttaagccagtttaacacaggaggtaccactgtgccacgcaattccctcttagcacacaccatgcgtgagctgcagtctttgccctccaggccttttcctatcataacacaggtgtgtccaaggcagaaaagaacattttccagaaggttcgtttccctccaagcctacaatgcttctttttgttgttattgtttttctgctactgacctaaacataggcattcctcctcctaacaggataaaaatcttgactctctcctttgcatcagctccccaccccgcccctgcccaaggaaataaatgctctgacttttccaagagtgcgaaaaaactaaaattagagggtggacaagatgatctccaaaggtgccctccagctccaaaactctgattctccctttaattactccacaagcgcattcttcacattgtttcgaactgaccagcgacttctccagggctgaaaagggtgcatttttaggcggaggcacccaaacttctaaatgacaccagtaccacaagtattcagaaggcaggaactaatccaaaagcagactcaggaaaggaggagggaggggaggacagagggaagggaaggaaggaggaaggaagagctttactgtgtgcccagcagaatttaggcgctctcaccctaggtaggtggcaactggagtctgggagttcaagtgcatccagcctgcccttcccccacacgccccaagagaatgggaagttcagccaagactcgcagcacctgcccgcggctccaggccggctgcgcggacccggagggaggctgcactcacctggcacaccaagcctccgcgcacctccggagggaggcggcacttgcaggtccgggggccgcgccgccatgcgcaacaacgggaaattccagtggcacccgagccccgagctcacccaccccaggcggcatgctccccacctcccgctggccccaggactcggaggtggctctggtcaggagcagggggcccggagacaggggaggggagctcatggtggcggcagggctggcggtcggcccgtccccggagggaggtccccgggacgcggcggggattcacccacggggcgcggcgctggcgtccgggtccccggcctgcccgccgccgccgcctcctcctctgccgccgcccgcccggaatcgctttatgtaaatgaagcccaactcgcagtttgcagcgcgcaccgcccggggaaggggggcgggcggggcggggggccttcggggatccacattacacagcaacaaagcggaaggttaatttgaaactcacagccccgctgccgctcggctccccgggcaaagcctgacatctacagtcgtgccgggcgcaggccgggttgctcggcggcgaccgcgcccgcccgcccgcagggacccggggacgcacagggacgcgcgggacccgggcgctcagctgcgctcgctccgcttggggcgcgggccttggggcaggccgggggtcccgcgcacccgcctggggccaggaaccctcgccgctcggcctgcgccgccccgggaaccggccccggcgggaacaaagcccaggccctcccggaggcgctgacccctcgctcatcaaaggtcaggggccggcctagaatcgggcgagaagaaagggacgcgccctcggccactaaaaggagcctgaggcctccgaaccggagccatcgctccctgggccccgtccacgtcacagccaggccactcaagcatggggacaggagccaatgtggacaggaatttattggaaacacacacccatcctattaactgctttacagagcacttctgtttttcagttgcagaaacttataaaaacatccccctgctctccgttgagagtttaaggatagtttttgaggccagagaaagagaaaaggagagatcactagaaagataggaagaaaagaagtgggaagaaaaggagatgcagtctaccatgtaagcctccaggctccttagcctcaccttataaagccacatcaccgcagagatagcaaagatcgtgccctttcccagggagttcctaccgccagggtaagatttaaagcggccaccccagttggtcaaagtgattgctgggcgcctttctatctccccaagttcaccttttccagttggtcaaagcgattgctgggcgccttctatctccccaagtccacctttttccattctcatctgaaagccagccccaaagaaatctcaccggaagtcctctgtcctccctgtcagaatcccaccctcagtctgaatttactcccgattctcacagcacagaaaggcacctgcttttaccctttctgaaaaccacccacccaggctggccttacagcctggagagtcttttcctcgggcacaataatgaaccatgcaagtgttagaaatataatcagctcatgaggcgaagagcagtatgtatggaattgtattagcatgaggcacacactgactcgggagaaaaagggatgcttagctggtgaaaaccatcacatccccgtatagaaggctttttgcacaatgtaagttgggttcagattaatgtaagtatctaacctgttgggtacagacagcccctttctacattttagtccagaatagattctggggaaatttatttatttatttatttatttcagctaaggccctgggagaaaagactgcctccagggaatcatgtccgattagggacaaaggagggcacaagcccaattcagtcacacgtgagagcacgggggccgggtggggggagttaagagccaacagggaaggtggaggatgagtttgcaaaccagactatggtcactgcagagctgcttccagaccacctgacttcaggcccaagaacaggtggtgttttcaaaacacactgttatttatattggccatataagttgagaacaccttaaagaaaacaattaataatttaattgaaaaagtgactatgaataagacatgaagatgacgtatgctagcaggaccgcaagcaacgtggcccacaacgcagagatgcctctggcaatctctccggaaaaacgaagattccttacctgggataggtaaggcctgctggataaattaaagacaacaagaaaatgttgatactctcagaaaatctaattttgctgctttatcttcatttttattaacaggggacaacctcgtaatctggtgacatcatgatcctggtaggcccacagacaaataccttcaataaaataaaagctagaaagcccaaagaacaagctattaaagtaacctgggaggatgcagcactgcctgggcagaaggcccggacgggatctgccctaatactgccactgtcccaagaggcagaccctgcaacctgcctcctgcacttgagaggcctgacaagtagaactgagagtgaccctgagttccttttctttatctggcaccagctacacacatgatgaggcctagtcaagcctgcctttgttccaggcaaaaatttaacaggtaatccacaggcaggtgatctatggcctctgtacattatggaaatgagggactacacacaagctgggtgtcacctctactaaaactcattttccttattcataaaaacaatacctcttcagagggaattggcaacttctgcacttacatatgaaatcaggagttcctctgaaatactccttgcaaattctatcctccagctctggaagccctggctcttcggagggcagctgcctgatgttaaacccatggcctacccagcagtgacagcctgacattctcatcgctccatcctgaacactgctgacaaataaacccactctcagaaaaggcaattcttccctcgcagttctccatacccagtctcgtctcatctggaaagcgtaattggcaacagccgaaaggataaatatttaaaaataaatcagggagcgctaaccccttccctactcctccccttacccactctccaagccagaggcctgccccctaacgctgagctggctggtaaattacaatgattctaccgagccaaacctgcttgtctctctctttctctacacatacacacttactaatgctgtatccttccacttttgcaaaggtaaatatgatctctaagatacagtggatgtcagcattctgacttccagcgtaacctgggctctcttttcacagtacagcgggtttagacagatttgtgcacccttccgggttcttctatttttattaaattatacgtatacattgatttttaaaactagtgcttaaataacccggaggctttaacaaagaaaaatccagaagagggcaagaaacaaaaacaaacgttcctgaaataaacaaggaaccatttggagctgaattggcctgagttcaccccatgattttgaggcagttatatttaggggcctggtacccgctgggtggccgagccctcctgggtatggaacagaatgcagaagttcctcagaacagctcacatttgccttcataaccattggaagctggtgtgccaaggcctgcacacagatgttttgattcacatttttctgctgaagcctcaaggcctccatccatccctacagtgctaattccatagattaatttttacccccaaatcgtaggtggaacattatctaatttccttacccaccctccccagctcaggtgctaaatctgtcaatgatatcccacaacaaagatacaaatgagtaaccattttttaaaagctgtgatttcggagagtttttctaaattaattttaagttacaaagccccaagttttaagaaagccaaaatacagaagttgccttaaaacagctttacatgttaggtaaagagctctctctctctttctcgctccttcttttttaaacaaaaatattatttctgaaagggcaaagggaatttgccatgcaagacttttaaacacagggggattcttacatttgtgtttctaaaccttgaaattgagaattttaatgaaaaggcggacagatgcttaaggacagcatcgcaatctgggtccatacattacaggagagagaggcgctttgtttggggccaagtaaaaagaggtgggctcctattttgttcataggccattcccaccgtctgacacatccctttacagtcggtctgatgctaaccactgaattcttggaggggaagcaggttggaaggagaagaaaggaaaagggaaacagaagaggaaaagaaatgggcgatgggatactgcctgtttatacaaattgtagatttaaaaaaaaaaatcccaacacggtatccattccatagtatgtaccaaaagcactttcacacgtgagttaaaacgatccattaaatgctatatcgaaagtacaacaaccagggttggagtttattttttttttttaatgaagaattcattgaggtttgcagttctcccctattaagcttctaaggatggggcacaaggcaggaagatagacaaaagatgacctttttcacgctttcccccaaataattctagaatcctattttcctatcttttcattttagggcatttgggttcaaaaatctgtgctaatctgacttcagagcccccgagctgaaaaattcacatatcctccaagtcagccagtgttttagaatttggatttctattgaggctgttccaatcgccagtgaggcctacggtaaaaacgtgcttcatgctgtttcgtttgtctctctgcagacaaatagaaactgtgaaatttaaagaatggatgaaaaaaagaagtctaaaacaaagaggttaaaaaaataggacaaatgtttttgcttttctgtctccccggagcaattgtgtggggaagtctgcattgacaataaccatgagaaggccatctaaaggcgatgcgtacacaaggggactccttccctgctgcctttggtctgggagaaaaagtaccttagctccgttctccagaaacaaaaggccagggccacggaaggggggagaggtgacaggggctttcacatggagccaagtgtcaatgctggttcatttttcacccgtcttacttggaaagcggctcagggaacttcctaatgactgctttttccctctctccctattatttctaaacctaaaagaacaaaacaataattttttttttaacctaaaacccatcattctattagaggaaagcctttggggcctatgcagtcagattttcctctttcctttcctcatcctgcttttcttttcttttttggaggggggttccaattgtagatcacatggaaataagagacactggacactatagtcatttttagtgacaccagaacggcctttatatctacgaaaaggcaggaaacggggagaaacacacatgcacaaacaacccaacagggatggaaggcggtggtggggaggctgcgggggcaaggccttgaaacactttctttttttcacagcatgaggtccactaatgccagcttcagatttgcaactgaatcaaagtctccgagtcgtcattacaaggtttttcggtgggtgggggcatggagaagtggacaataaggatgtattaaagacacagacaaggtgtggcaggggcaaagtggggggaggtgttacaaagaaaggaagctgagatgaatcactgcgtgccatgaaaataccagggcgagtggatgtcggagtgtttaaccagatttgaagctggaagcatcttccccagcgggcaaaccctaggacgaggcacagccacgcgaccctcagcctttgaacccagacctggcagcttaggagcacactcccccttccccaggcagccacaggctctgagctgaaaggcaaggcgggggtagggataagagggccctgcaaagaagcacaatcaacaactcaaatatgaacggaaatgacgtcagcaaagtgaaggacctgtttactgcagatcaaaacaaaacaaacttccaaaccttttgtgtacacaagaaaactctataaaaagccttcctaaaatgtcaccagggtcgacacatcagcagccccacaagaaaacgcatgacagttaccatggagggaggggggaggaaaggggctgaagggaagatgatctggggggctggggggaggagtgataaaaccagaaggagcccaaaacccagttactactgccccctctgctgatccttaatatttattggtgtttataatctaaaagccatgctccacgtttcacttaatacaaggccagacagtgttgtctaatgaggtagcattacaatcagcttgtaatactgaatttttaatgctgccaaggattctgttacataataatatgaaaaacagaagctgaaagtgggctcgcaggggacaggacattcgaggttccaggcaggcgagcgccaccagcccggttcccctcccccacacccgcccccctactttctgacgtgcaatcaaccctccatcccgatacaggaggtcggtatggaaaccaggaggattttttttttttttttttttttttttaggaaatccacacttttcattattattgttattatactctcatccgaagtttatagctcaagagtttgaattctagcttttctggggttaaaggtctaaaatgaaaattaatttttttggaagaggtggcgaagagacaatacaggggaagagaggggtagcttattttaagcaaaccaagaaatttgggagaaaaatcacagagggagaaagaacttggtgggggagggaatagatgtctgccgaccatattcacagctgccgcactcagtttacattggtgtaatttaaaggcatatatatagccgccgttgctcctctctgtaataccccaagactgtaaatctataaccactgcaatgatttagtgattaaaaacatgataacatattgtgtaactgcaaaccacagaacccctgccaactctctctctctaagataaaggggaaaaaaatacagaaaatgtgttgcttgcagccatcttcctaaacccaaaagattttaataaaagaacctatacagcagacgaattggaaaggggtgagtgaattctgtgtgaagccagcaaagggagagaaaaaaaaaaaaggcagctttatgtgggattcttttccttgtactaacaaattacgacctaaacatgccttttcttttctctctctttttttttttaatagtttgttgtaactggaataactggtcttgtgcactgtcttgcatattcaaagctgctttgtaaccggatctagagacccaaccttatttgcctgaactcaatagggtttttttctccccctcctcccgggttttgttttggattcggtattgtgggttttctgttgttgctgggagcctatgtctatgcaggcataggctctggtgcctttaaaccacagaccaaacacctgaaagggggaggcacaatttgtacaatggcaggaggagcctaaaatatacaccaaaaaataaaatcaaagcagctgtaggggttttggcctctgagcagctgacctgaccccgttctgtatattcttttatttccccattgcaggattcctgcaccttgggtcagattcaaactcaatgtgaccctgaggagaaggcagtcacagagtcctgaaaagctgctccatatttaataggggtgggggaagtaagtgcatatgcatccagactcccccagtgaagacacccacacggtgcagacgtacgcgcgcgcgcgcgcgcgcgcacacacacacacacacacacacatacacacacacacacgtcaggactgccaggccatgggaccagctccaccccagttttcttggcccacaccactgagagcctgaactctctttgcgggccccccaaatcctcatacctacaactctacacacacacacacacacacacacacgcagagaacaccactcctccagagactttgtatgtttaaaaagtccacagatctgaatcgcctcctctctggaccggagcagggcagtttattcagagaaatcaataggaaagagcatttgcaaatatttatataagccctgtgcgtttcagcattaagtaattaaaaactaaaacccgaggagggggaagggagacacacagacagaggaaggctgctggcctagagtaggttttcctgcccacacctcatcttcccaaaccgcagtcttttcaaaactgactccgtgtacactttttacgaaatcctcttcgtacaccatttgctagactatttcaaaatcatctccaaatatggattcacctaccaccaagctttcaagactgactgtgtctgtattctatctctcttctcatacacacacagcaactcatacttttgacactgcgtcaatctctagtatattctcttttattttcctatctctaatatacctgcactagttaaaaaaaaaacaacaaacctaacattgtaagataagaagagggccccccaagtgcccattcaagaagcaaactcccaacccctaggtctcctgaataccccccactcccctcaacccacaggatgtctacactttgggggttcagctcctgaaacccccacatgtaaacagatttggaaaaaaaaacaacttcagcaaaatggagttttagaatgagctactatggagtggacttccctatattgttccggagggcagggcagtaaattctggttgttctccctctaaatcctctctaagaagccaagcaaggcgctggagcacccacgctgcagatattgtagaaatttacagtaaatgtaggtacacgattgcagcacgctgccctattgattatgcagattgtgatcaatcttctcccctcgcccactgcccaagcctctttcggaggacctccaaataagttggtctgcaactagctattctcccaaagtagggaggaaaaaaagtaattttttaaaaaacataataaatcctcaattgtccccactgaaagggctcgagtcttttttaaattccaaagtgaatttatgttctgtaatttgcattacagccaagcgatcaccgtctgtcatattcttcaaaggtacttaacaaactgccttttaaaagtcactagaactggaggccagaaaaaggcaatcagcatgctccgtccatacagtgcttagatcaagtttcaataattgagaccaataaaaattgtcatatttaccctacttgaaagcaacaagggggaaaagttaagactgggtgccttttgaaagcgcttgtaatcaaagaatttgccacagtccaaagaatagcacaacattgaacaaaagtcagattctgagcaacagcttcactcgcaaagtgatatatacatattttaattcaatagttatacaagaaccctccgagtactgagtccatacacaacttaattatatacactgcatgaaatacacttagatctactctccaatagatatgcaaaaagacggacattaaaatgcataatgtaaaattcaggaacacggtttttgcatcgagtggagccgggcgaggggtgagagtggggaacccaacgtaaacaatcccagattcgcgagagcaaaaaaaaaaaaaaagaagaagaagaagaaagaaaagaaaaagaaaaaaggcatcctcggatgtctctgagctcagctggcggaagaaggccggccgggcgaggtctggccctggccagcggcgcagccccgagcccccgggagcccctagtgtccagggcagagtcccctctgggcgctcgcggcgctgccagtggggcagggcggagagcgcacaggtagaggatcgcgcggccgcctcgccccctccgggaccccgtggctccgaacgggctcccgcgtcgccggcaagtcgagccccagcgcggaaggcgctcgcccggccagcggtggcggccgcggcagcagcagtggctgcgaccgcggcgactgctccgggccgggtgcgcgccccgcgcggctgctcagcccggggccccggcgcctctcggggtggggcaaagttgggggccgggagcggcgggggcgggggcactcggcaccgcggacccccccatactccccccaccgccggccgccgcctttgtctccgagctggtaccccggccgccctcccgccctcggcccgcgccccggccggccctgcctggcggcgcctccaaactcgccgcgcgggcctcgccccgggcgcctccaccctcccgggggtcgccggcggccggcggcggcggcgcggggccggggaggagggggcggcccgggctcggcggcggcggcggcggcagcggcgggaggaggaggaagaagaagagaaagagaaagtttggcgtagggggaaggcgagcgggacgcagcgagcgagcagggcgcgggcgcggggagcgcgggcggcggcggccgggcgcgagagccgggagggggcaggacgagccccatgcaaagcagcccgggcgccccgaggagccccgcgtccgggcggtggcggcgggaggaggaggaggagcaggcggcggcggcggcgggaaaaaaaaaagagggaaaagttgccacttacgcggttgcttctccggcggcggcggctgcagcggcgctgctggcgacggcggcggcggcgggagctggcggcgcttttaatcccgaaaagaggcgctcgggccgcg

SEQ ID NO: 2620 - DNA, 265490 bp, Homo sapiens
tttgctcatattttttttttaatgtatcacaatgagcaggaaacatacttgatgaaatattttcaaaggagtatattcaattaccatctacaatcaacttaactatgacaacaaagtttttgtgacaaatttttttttcagtttgaaagttccatgtggttctgtttgttagtctccatgtattttggtacagttcgagatcagcattgttacagtaacaaaaaagctaacaagactacattatagaaaaacaccaagaacatcatttttggtttcacttgctctattttttttgttgttttttgtttttttttctttttgtacattgcaaaggctgttcatatacctcttcacctcagggtcacgttcatttatgctttctttcctacccaaacttgcccccctcccccctgaagaaagtaaacaaacaaaaaactagtcaaagctttgtttcacagtgggcagtatctcagcgccaacaaacaactcaatttatgcttctatttaaaatgttttaatttattatttaaaaaaaatatatgtccatgaacatcaagtgcactggcttgggtcactgcctctctctcctgcaacttcctgccatgcctgataaactcaggtttaaacacatgccgtctgttttactttattttcaattgtgtaaaactttggccacattcatctctttaaatagcttgtaattaaaaaaaaaattcctagatgtattaaatttttccttgtgtagatatgtggtttttggaaggatggaggaaagatggatgaaataactcccattctgtgggtcagactggtgtctagcaccaacccacactatagggagaaaaccaaaaaacgagtgtcaatggaggtgaagaactaatttaaaaagcaagtggaaatatatcctacccagctacctacaatgcagcagacaggaataaattccccaagtgagataaagctaaacaaacagttgagcattgtagtgaattcatgctttgtaaatagtactggtcatagccacgatggctgtcagcccacaaacatctaactcatgtttgacctctaatgttcaccatcactgactgctttgctacttctgggttagtgctgagaattattcttacttttttcaatgaacatatatgtgggcggtttagttgcagaggaaagcattaagggtgcaacccactccaggttgaaacaatcacataacccctctgagaacactaggtgggtggaagtgtgctcagccaatctattcaaccaccttattgtcgccaaacacccacagctcaaggcatggcataacaaaacactgacagtcactctgcctcacagagggaggatggcatagtagctccatgaaaaaaaaaaacaaaaacaaaaacaaaaacccaaaccatcagggagggggcagcaaaattataaagaaaagaacttaaaagttgaggggggagggaaaaggatagaaattgcactattaccaagcaatatcatttttaaaaacaacgttttcagagaagacctagcagaatttgacaggtaaagctagtgttacattgttaactgatatcacatagagaaccaaaaacaaaaacaattttttttctatatggtacagacacagagtaacatacaacagttaaatggcaaaaaatatatatatatatatttcatagagttacaaacaagataaaataatggaaaacaaaaaactgtacaactttaaaatttaaaaatgttcatctcaaacacaggaagaaatacaagatttcttgttaaaaggaaatagcttgttaaaacagtaaatgttttgcgtacttgcttttgacaccttatgctacaactggatactggtatgaatagttagatggtattctttctttagtatttctacttaaaaaaaacaattaaaaaaggaatttgcactgtgcatcagcctagttagaaatatgtacaacatttcaggatctactatttcattaaactaaaaacaaattcataaaaataaaatagtcccggctaaaaaagaaaaaaagaaaaaaaatccattttcagatcttggaatgctccagtcttttgcaaagtcgatgagtggcttcagcactggggaaagaagcccgaaaggtgaccaatggaacctgtattcacagtcttcaaagttcccttttgaaacataaggaagaaaacgaagggaagaaggatttcacactttgggggcaaggggagatggtttctgttgatgtttagctatgaaagtgaaacagcaaagcatctatttatttgtctccaaaatctatgttttagcagcacaaagttttcaaagttcagaccatttatttatttttctttttacatgagaaagggtgtgtgttaacaggaatatggatattaacagaaacaagtgcctcacatacagttccttttttgctttctgtacactgctatctgctgctttgttggctgcgctctggatcactcgctgctcagactgcctaacacaaggacaaaactttgaagtaaaaaatgtgtcttttggtatatggaattgtcattaacatttgcctctctgcttgcagaagaagcacataacaacctgggaatcttttgtttttctctttcttttattaaactaagtcttgtttgtttaaatcagaaacaaattctcaagtaacaagaaccctttcccttttttctgcatcagcagtgaaagggtgtgtctttggattttatttaaagcatgaaatttttttttctgagagaggaaagaaaaaacaaacacaaaaccaaaaaccaaatccctaaccaaaaactttttttagaaaagaaaagtacacagccaattacacaaatggaaacaaatcctttagtatagaaaaaaaaagaatatttgaagctcctaccaaacaaggaggaaaagaaggggtacaaagaaaaaaaagccaaaagaaggataaataaaaaataaatgcacaaagctaacagacacaggtaactagaattatatgcctttaaaaagtttcaactccccaaccaaaaataatctgtgaggatcctaatgacccctagaatcccttgaaattctttctttagttttataaaataattctgcagctccctctaagaaatgaaggcagctaccttaagtgggagattataggacgggaggtgggagaaggaaagagaaagtggaattaagggacaagaaagagaaagtggaattaagggacaaggggagaaaagcttaggcgaatcaacggattgcaatctatcatctgctaggaatgaacaagacaacatcaaatgaggagctgtcagctggaccatacaaaaagctaaatgtacacaaaaggtttttttttttttttccttttaaatctaccatactgcttcagttcatttccaatgcaacaatctactcaacaccaaaaatggtcatatctatcataaatacagaaagtcagtttttaaaacttattttttttaagctacaagtcctcaacactctttgtgtgtgtgggttattatttttttttttttttgaaagtgggagtgcttaacttttccccttgaaattggcttcagcagaaaagctatccttaaaaatccccagaaagctaaagcagttcacattgtttttcttgaatactttctgcccatttttaagttaacaaaacaaaaaatcttttctggaacaaaaaaaaaaaaaaaaactgaaaaaacaataatatataaaacaatgattctgaaaacaaagtgtgagcgattgacctgagaataaaaagacattacatttctttttttcttttagcaagccattggtatctgaatgctaagatagcaagaaatttaaaactgtaacaaggtggactgctttcccatacagtgcatgccgggctcctctgtgctatcagcgtggggcgtttattgaaaaggggcaaatatacaaggggtttaagctccaaagacattagggaggccctgcggacttctgtttcccagaccaatagtaccttcaaaaggacacaatgtaacagggttagggctttttttttttttttaatattaaaagaaaagaaaaagacaagaatgtaaaatcaccggcatagataggtatatgggaaaacaacccacgctttttcttttttttctttttttttttttttttgttttttggttagaagctttggaattgcagttagtctatttttgaaattggtttgttattaatttttgtatttaaattcatttgtttgtattgttcatcttcaaagcttacaatctgaaggtgtccgttcctacactggtcagaccactgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgaggtaaccgttgaagatgaggagagaggaggaaaagaagggggcttcgctgccgaagcccgggagaccacttgcggccaagacttcctggaggcgtggggggaagcggaggagggggcggcggccgacgggggaggggggctgtcgtttgagtgagcggcagactgcgaggtagatgcggtgctaggatcggggaagcaggcagagtgaggtaataaactagggtgctctttggcgtttcttgctgctctcgtgattgttctgtgtttgtgcaaggccgactcgagatgttgactcagagcttcctccccacagagcgcgctctcgcacgccaggcagtggtacgagccgccgccgccgccgccgccgccaccgccgccgccgccgccactgccaccgccgccgccgccggtggggacgtgaagcaccatctcttgcaggttcaccacagactggccgaagaagcagagggacttcaggtggctcctcgctgcctcctcgtcgctgaagcccgcctggcacttgcggcagaccaacttgtactgcacctttggaacaatgaaggggtcgtagagggagtccgcacttttgctttctgcttctggctcttcagggagtttcggcaggaggggggacacctcacggggggtgtttttctgttcttctggtttgggggattctttggcagggtctttgtctggggaaggagccccgggggggactggggtttggcttgctttgggctgctgctgctgcactttttgctgctgctgctgctgtagttgccgctgctgctgctgctgaattgcctcctgcagactctgctggtattgctggtactgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagcggggctgagatcgtggctgcagttgccgtgggggcctctcctttctccttcttggggacaggcaggggttcccctttccctttgtgtgccttttccttctcctttactttctcactgtctttgtccttgcgttgctgctgctgttgcagtgggagctgtggtgtgggtggcggctgggctgctggcggcgggggaggctgctgcacctgtggttgctgctgctgctgctgctgctgggggggttgctgagggcccatcgccatcgtggcttgtgctggggttggggagctcagcgacgctgaggacggtttatttggtaatccagaagtggggaggccaggggaaggaacagttgtgctgggcagacccatcaagttcggcttaggagacgttaaagctgaaaggaatggagacagaaatcaccggtcagtctgggcaggggtagggctgaagctcaagacgttttaccggtgtcactggcacacagtttgagatgtcaaggcttgaaggatcctctcaaaacgaacatttccaacagaagtatcccaccaggctcagggctggacaaccttgtattctaatgaggactcagtcctaggtcagctcccatacttcccctttcagccaaacaacttccagaagtatcccaccaggctcagagctggacaaccttgtattctaatgaggactcagtcctaggtcagctcccatacttcccctttcagccaaacaacttccagaagtatcccaccaggctcagggctggacaaccttgtattctaatgaagattcagtcctggctagctcccatacttccccttccagccaaacaacttccaacaccttcctgcccaatgtgccacacccgctagttcacattttctttgccaagtactcccagctaccattcactctgcccaactgcaattagtctagaggccccaaagctagctgtttctagctggggcccatttgcaccaaaggccttcatcacaaaaatagtatggccacgaggtccccagagaagttatctggaggagagcggcaacaggagaagagagaacgaaggcaagaaagctagcacggccacatgaacaaaaacaaaacaggctctacaggtgttcctcctctctgacctctgttgctgcagctgactggatgctttcggagggtagagagaagatgatgaataggaaagtgtggaggaagggcctgggaagaaataagaacaatccattcagggaaaattgcttccatgccttggcccagctgacctgcttcaacaagtctactcaacagtataaccgcctaggaataggaatctggaatctgcgggagaaacgaccatcttcttttcctgcccctgtttgaatgatacacaggagggccagtgggactgtagatggttgagaaacaaccgcaggaaaagcagaaaagccatgtcagaagtggaatagcccaagatactgacaccaattcccaagacatcacaacctacccgaagcaccactgcctatggatagcaaaggtctgaccatatcaccaggccctcatgggctagaatcccatccttgatcatacccctaatctaccaccactccctgcaacgccttcaccaacccgagagcctaataccctccctgacccatagctatctcctggtttgagtcaccaggtccaaggtaatgcaagagggtgttgctacggatggtactccaagcttcaggtgtgttgagactagcaagatagtaggtaaggacagcatgggggtggggtgcagtgtgtgctggacgatgaaaagctgagaaaacaaagaggaggatcccacaggcaacagctctcagaacacctctatattcaccatatccaagaaacttgatggtatatacatctcttcagaggacaccaaaatgcaaaatcaaaatcttacttcatctggacctcacctgctggaaagctggggaaggagttccataacatgacactgaggaaaaaaaagcaagaaaaagcactctgaagcccagacttgggggaagactgcagatttctggctatcatggtagtgttcaccatcaaaaccctcagatttcagacgaaaagaacaagactgcttcaaattgccaatcccagacaaacagctgttaatactggatagccaaggagaaaggttccttcagcatctcatcatgcagtgtcctcagtgcacataagacaccagagaagatatgtgtgactctactcagaaaagcttagtaaagacttgttggttaaattggcacaaacaagacagagtagattatgagttctaaacttgggacatggctctgtctccactaggcaatgggtctgctctcagtggggcaaggaaggaatatttagagatttccccatccccatggctccagacttctaggagaaagattcaggtcaaaaagccttaaactgtgtgtcttcaactgatggtctatataagaggttcaaattttaagaaacgtttacgaatctctactatttaccaagccttgcactagccatgctagacacagtagctcaacacactcacaactctgtgacatcctttttctgatctgtaagatcagaatcaggcaaggtacttcatcccccctagacttactcctacaaatctggagtcacactgaccctgtgggattatggtcacacacatcagacgtgtgaccctgggactttcggttgaactcttggaacctcagctttccataacagatggttatgaggattaaatgaaagaccacattgatagaaaaagcttagcattgggcctgacatataatagatgtttaataaacacaagtttgttccttccctcccattccagatccggtgtttttgagaactgtgttacggtcaggtgatgataactggggcatgtctgctgccctgaataaataagagcttatctttctatctcgagtccactctaagtggtcagaacttgagtagcactaaacatatacctgttgactgactggctcatattgggtgttgtggaaggagcacatagcacctgggagcccagaggcctgggtggaagctctggctcctaccctagcttgttgaatggtcttgacctctctggccctcagatttctcatctgtaaaacaagcggaataaatcatacattctgattctacttttttttcacattactatgatgtgttaagccttcccaagcccctctgccagggtcctgggctgcaggggtaattaaatgcttctctattttccatagtttgttttcctggcttatgtctagctggctttctgtgacatgacttgtcaacacatataagcaacaacttctatgtcttaatgctttcttttcttattctctttgaataagaaatggggaccaggaatgcagtggccttatgtttggtaaaacaccactcaaagtgtaaaatgtggaactaattcaaccagaaactaagattgctgtgggaagcagcacagctgctttaacccctgggaacagggacacattttgaaggcaaggtagcattaggaggggttctcctttggtgaactggaactaatcaattcaggccattgtggggggaatttgcagacttatgtctaagcctaacaggaccctggaggtgaaggtccaatttagcaaagatggctggatccagagaagatgtgaggacagagaaggagaaacaagagaagtatgtaggaagaactgcaaaactccctattaagtgagactataagagcaacaaatatgtatgattctcagtgatcaggagcaaggaaaaggaaatgggcaaaaggaaaaaaaagaggtgactgaggacctctgaaatgtgcatcagtattttaacagaaccacattgcccaatacaagattcctggtcagtgcactcaagtagaacggccatcttgttaaaaacagccactattgttctggctagaagagaaccccaacattaaggatctaccacataagaccttctggtagttcttttttttttctttttttgagacagtctcgctgtgtcacccaggctggagtgcagtggcacaatctcaaaccactgtctgcctccagggttcaagcgattctcctgcctcagcctcccgaatagctgggactataggtgcataccaccacacttgggtaatttttgtatttttagtagagatggggtttcaccatgttggccaggctggtctcgatttcctgaccttgtgatctgcccgcctcggcctcccaaagtgctgggattacaggcatgaaccactgcacccggccctgatagcagttcttttgccaccgtagctctctcaagaaggcagggaccccaggtgagggcaaagagttgatttaaatgctcttggaccagttttcttagggcataatccagaattagctaggactaactcaggtgtcttatatttacaacaaatatctagacaggatcagcatttccacaaggactgaatgaaagggtctatgataaaaacttgtttcttgaaatattccagaaattagtatgccaggaccctcaagtttttccctattataggggataagagtggtttcaaaggagactgttccgaccaggaggtcccatccctgacacaccagtacttgggagactcaacaggaacgaactgaagtcttgttgcttttaaagaactagaaaggtaagcttcccatctgcccagcactcagagggtttgggtggtatccacataacagaatgctgactgggcagctatttagccctgaaacaatcgcctagagcagaacccacctgtgttggatggagtaaagcctggcaaggaggggctgttgaggcccgggagcaacacaggaggaatgccctggagcgctggatatgctgtaggaaggttaagggcctgaagaggggtgttgtcaaacatcccttgctgctgagctgccagtccaaggacctcgttggcctttttaatccggtccaactcttgttgagccatcaactgacgtacggtggctgggtcaaagtattctttctccttgtccagctggcttccaatggtgtctttaactttggagatatgctgttgggaaaagatatggtcacgtacagacagccgagcgctgtacttgatgccacacaaagtgcactctgttttgggtccctcataactcgtttggtttataccaaaatgcttggccatgcttaacttggacttcttttcttttgcccgggcattctggaaccagacctgaacgactctctttggcagtccaatgtcattgcccaggacctcacattctagcatagtgggtgtcctgtagtcattaaagcatgacttgaggaccttcagctgcagattggtcatttgagtgcgaaaacgtttctgcccaggccgatctccgctgtcaccagatttgcctgcagatccactcgcaccaggactcggggagcagggatctgcaaggcttgaggtttcactgtagtccactgtaccttcattgtcatattccttgctataaaagctcggggccgggctgaccagaccagatgacaaccgatcttcatactcagacattgccatcatggccgctttggtcaacccttcgttgggtgcagaagaggatttggtttcagttgctattcccgttgcactgtcgttatctgcgttgccctcgtctccagttgtggtatctgtgattgctgtgttgacagaggaacagtcatcgttgtccagcttagtttggtcaaagtttagattaactgaggacatggaggggctttcaaagtcttcaatcccttccaccttaatggaggaagggcttagaagagttctgggtgacaattccatggttttactcacaggtgagagggggacaccctgaccatcactactgcttgggggtaggtgggaaaagctagttccgtcaaaaatatctcctttcatctggagtcccccatcacagtctaagagcatcgcagacagagttaggttgtagccagctctcttggcttcatgccagtgacgggaccggatatgagcctcaagagcagtcttggctttgaagagcgctctgcaaaaagggcatctcctgtgggcctgcgctgggcctacagcccggaactgtcctttcctttcccgagctcgggtgttctgaaaccagacttgtaccacacgtttcttcaagcccacctcgtgtgcaatgtgatccaacatctttcgagtcggattggaatccagtagatacttctggtagagaatttctagttgttccggtgtgatggttgttctcaaacgcttgtctctctgaggctcttctcctcctgtcccactgtcgttttcgccagggcttgcactggccttttcctccagcttcctcttgagagtgttcattgtggaggttggagttgaaggagaagtggctgagcttgctggaatctgaggtatggccccagagagcagctggctggccaggagtgggttactgggatcaaagagcatgaaaggcatatccagggacctgtccaaaaactgggggtggatgaactggttctgcgcgctcaggaagtggagctgctgatgctcctgccagtgctcaaatgacggaaatgccaacttacactggtcacactggtaggggattagctgaggaggtaggtttgcgagctgttgaggagttgatgtgtggaggggcttgaggggcaggtgggagagctgggaaggactggggctcgactggggtaaggggcactgtggagggggcgcttgtggaggaggctgtggcaacgaaggcagggacaccagctgggggagcttctgctggggagtgttggtcttctgctcgggctgctcttgctgctgcagctctggctttggttgtccttgcttttcttgggtttggtttggctgtgcactgggagcttccgccagctttggtttctcatcgcctgcctctgtttttgaattgaaggtggccagttcctcagcctccgctgtaagctgcaagaaagcggaggaagctgtattattggctgatggtgctggggcgctgtaagcctgtgagggcatcggggtactgcaggatgagctggtaggcgtcaggatttccatggcatccatggaatcctcattttggctgtcgtcctgcccctcctcatcctcatccttgtaacacagcttcttctggtgcttgatgagatcaaagatgcgctgaaacaccaggctacattttttgcactggtagttcaagttgcttgttcgaatgtatctatcatttgtaagctcacgccgctctccatctttgccctctccctgattctcataattcttcctggccttctgtcgggcattctgaaaccacaccactatcactcgggttggaaggttcagtaaattagagagttgctcaaattcatcatcctttgggtaagcattggcatcgaagaagtcctgtaagaccctcagctggtagtccgtaaaccttgttcttgaagacctcttgcttccccagtactcctgctttggaggttccggcgaagggggccgggagtcaatcttgagctcctccaggctggtgataggaggattactgaagttgtaaggggagtccttgttacgctgcctctctttgaagagagtgttcctgaaccagtgcttgatcactttctggggcaacccggacttgtctgccatctcttttatttgctcttcactgggggagttgttaatgtcaaaatattgccgcaagactcggagctgatcatctgtgatcctggtgcgaggcctcttgttctgctgctggagcagggttggattgagctgatgctggtagagttgggccaggtccgcaggcagaggctccacaggtcccagctgcgggggtagctgagccggcaaggtctgcagcggcatcgtctgcatcatcagcggcgagaagatgggcagctccatcggcatggagagctgggtgagcggcactgatggctgggccggtgcaattgtaggtgaggtgatgggtggggctgatgcggggatggctggtgtggacgccggctgaggcggcgctgccggaagtgggggtggagggggtggagggggaggtggtggtggctctggggtctggggcctcagtgggtacagtttatcgtagtggtctctgtactgtttggcaaacctctcgagctgtttgaaaggaaagtaattctgatgaacgtgctcttgatgactctttaaaatcaagatgttggaaaacaacttgccgcaggagtcacactcgagcttttccaggttctctccctggtcagtcttcccattctttttctgcaccttctgcttgttctcattatactggatgaccaactcaaagccaaagttctccagcagggccttggtggcgttccctctggcatctgaagcaatgcgtggagggagcatggaaggctcagaaccaccccctggtgccaactctttcttctctttggccttcaaggcatctggcagtgtttccttcggaccggtgttgccctctcccccctcggcgctgtccctctctctctggctttctttttccttttctttgatgaccaatttgttcttcttttcggggtgctggcttggctgaaggagggcagagtgactctgggctatagagagttggttctgctgctgctgcggcaagatctgctgatggctctgctgtgggacctgaacctgagccttcagatcttccagcaggcctgggcctgtcccagtcagtgtcagtgccccactggtcactggcaagctcacctcggggttaagctggaactcagcactggggatgtagaaagggaagaggaggtgctgctgctgctgtagttgcagcagggtctcagttgtcatggggaagtgaggaaggagggtggggttaaacagctgagactggatcagggcagcctgttgctgcagctcctgctgcaggtgagcttgaacttgagcctgggcctgggccagcgtttgtgcttgttgttgttgttgttgttgttgttgttgctgttgctgctgctgttgttgctgctgcctggatgcaatcatatctgccagtttcttccgattggcctctttgggctctgaaggggaagcaatgttggcaccaataggattccccaggggtggcatccctacactctcagtgggcacttggcttagtaagttagagcttggagcaatgccagcactgcttggattggaggtggtaaaggtgttactgccactggtgctcacaggacttggcgtggaggagctcaaggaaatactgctgctgttcccagtcccattgctgctgccacttgcagcctccagcttggctgcccgggccttggtttgatgtaacacagacctcatatggatctccagagtggaactctggctgtaggccacattacaagtgttacacttaaaaggtttgttgtctgggctgctggtgggttctggctgaccggttgctgattcttgaagggctctctttaacttatgcaggtgggagacagaattgtagtgtactagcaggatattcttttgagtgaaagattccttgcagacggtacacttgtaagggcgagaagggtctaggaacttttccatagtaaaattgggaccttttctgaaaggcagagctctctttggctctgagcccgagtcttcttgtactgacccagagtcactgcccgttgggctctgtttatcttccaagtcactctcttcctccttgtcttcctcaacaattatggtatggtcctctgccagagtggggtctcccattgccaggaggtccccattggccagcaggccaccataaagctgttggatgtcagcctcactcagctccaggtggcttgtctcaaggtgcttcttcagagcctggaaagttcggaaactgcgctgacaaagacagcacatggtggcagctctgatcacatggtactgagaatggagctgcaacttttcaatggtcttgaaggccaggctacactgattacagcggtacttgtacacatggcgatctgacaccggcagctgaggcctcttggcatgcacttcattaaaatgcgtctgaagggcagcagaagttttgaaaacctggttgcaccccttcttccagcagatgaagcctgagtcttctctcacagagcctgggtcagcaggggatggtttcaaatctccgctttgctctgtgcttgcggatggcaagatgttctttcccagatcctctgaggtttctgttaaaaaaaaaaaaaaaatcaaacccaaagataaagaaggctttgtttcaaggatggcacccagagcggtctacctagtcaggcctcatgaacacagaatctgatgatgagggaagtgcccaacctgaatgacagaatctctgcggagcgcctcctgctttcttttgttcctccaatagagcacatattataaacagggtgcacatgaacagagatggataaaaggaaatacaaaaagtttcaatgcataatagacccatgtcatatcacagatctaacagtcttttaaatagcatttaattgcttgactcagaatcctcaatttctcaagagctggtttgaaggttactgatcttagactggatttcccttttatgttcatcttttatgtaataagcatttagcacagtagatctgaagtgtagaatatgtgaattaatgctgtcctaagttgtgaggaatttacaagaactgctgaacatcgtaatataagaaatttggggatacatatttttaggcatttaatttcttgttataatgtgacttctgattgccatctctattcaataagcaattaacattcaagtgttcaattatttaaaatacatttttttccctacaatgagatcatcacactcataaataccgagaccctttaacaggtcatttgtccattgtctaatatggaaaactcacaagaaagagagaaggcaggacagtagtgtggccaaactcttcccaacttagaactcttcccaccttagaggtgaacgatgtaggacagcctcacagaggtctaaccattcatctagccaggaaacactatgtggcaccaactactgtctacaacaatgttctttccatcagcatctctgtgcttcatcctaagccaatcccaaaaaactcagaacgaaagacaactaatccagtgtacctaaaaatcaacccacaagtccctactaattaagtcctcagaaatacagtgtttaatggcttagaatggtagggcctactgactgagtctctggttattcactccctaattgtatagtttaagaagatgtgtgtgtctgtgccagaattccactggttctcatactaattttctctcactttaaaccatgtgagtaatatacaaatacatgccaagaagcagagtataaagtagctgatgacagtgcccctcatctcctgatcagttacattcaccttaagagtattgtaaagaattcctgaaaacctttctccatgaacattttggcattccatcttgtttcaatttcttggggtcaagaataatgatactgaccaggctgctttcctgcctcttccaaattggaattcccatctcgatctggaacagctgctgggaggaacatgctgcttggcatcaccatctcaggggtggtcacctgaggagcaagagcaaggagagtcaaatggagaggaaagcgacacaaaataggaaatgtttaaaaattatttaataagcaaaattagccttcaccagtgtaaagctagaggtgtctcacttttcatagctcactgaagattcatgtttattagacaaagctcacatcagtcaaaagtgtttctacggttacattctggacataattagcagtgcacacttgaagaataatcttcttattaatatttttcctttatgcagaattttgactttgatcactgacaatgttttgtcatgggctgtgaaacttcttgtgcaaccaattaggtagataagttgaaaggcccaccttaagctgctgaaaacataataagggccctaattaaatcatacctagtaaagtacactgtaatcttgaagcagggagcattgtagtactgttttcagaacgtattcaggcaagaggaggaggggagtaagagtgaaggaaagggtaagaagaaaagaagagaacaaagggaaggctagggacacgcagacatgctggcagattttccaggaaaacaacatttgtaaccctttacaagctgacatcaagcacaaacaagcctttttttgtgactcacttaagccacgatttcttctggagtctctgcccaaggtatacaacatcagagggaacttctgaccaacgtcccagcgatagagggtggcctgcacagcattctacaacagggcagccccaccttgaccatggccattttttctcaatacagcagttctggaaatcgcctggatccaaacagctgcaacttttgggcagagcctcagatatttctctaggcctccctgccgtacggccagaagcctgtccaaacaagttatcatttgccttatgttaatgtgataagcagccctcgatatccaatggaaagatcaaaggttcttcattcaaaaagaagcaatatccttttgcctgatatggggtgggaagggtaggtggcgatgatatttcaaatgaattagaaaccacctcccatttgatgatagctggagaaatggactgacctagaagttacaggaccagaaactacagtcaccactaacctttctacgtggcacccagccccacttggagacattatttttccatcaaacacaaccgtactgcacagacatcttcactgtctgttgcaaagattggaatacgtagatttctgttcaaaattaaataatattttaaatacattactattaatttttaatggtgtgacgatcccagccttgctcaaaatagctactgagatgtccactagaatcatcagcaataagcttgacaactagaggaaacccagacagccacccccatcaacataggataactcctcatcacacttaggggtattagaataatttcagcaacccagatgccagcgggtgcaaaaagtaagcaacaggtaccatggagaagcattctgagaaatgctgtgtttacgaagagcaggtgtgtggcaggtgaatgtgtgtgacatagcattcttgcccccacagacatctgcacctcacacaaagctcatcggcagctggttaaggctagctgttgatgaatcgttaagaatggagtggagattgccaaactcattccatctattttctttttaatagaaggcatttctgactagtgtggttggggagtccagcgggaatccgagaagtgaaaggtcaccgattaatttgtagtcctcagctgagggggagcacgaggttgggggtaagagggggagaaagggaaaggaaaaaagactcccccccacctcctttctcggttgtagctgcaagatcagtcctttcctgggatctttaggaattatgaaaaatgaatcatgagaaataaaaaaaaagccctacagagtaaaaaagaataaaattatctaacacctcagctgcacatcattatagaaaactgtgggcttttcatacacattacagtaaggcagacatcccctctaacagactcagtacgacggatcagtaattgttttcatacactttaattagaaaaactcagatggctatgaataataatggaaaagagagacttttgcacttgaaaggttgaagtcaatcaagtgtgaatgacggcaaaaaagaaaaaaaaaagacaccaattcatcagccctctgttgtctcgctgcgactttaatcataattcctgattgggattcaagaaggcagtaagcagcggttctttgtctgccttcaccttccatcaattaactctccccgaaatataatcatcaacctcacatgctcctctgcatcttaatctgggcctccaaacctgtaagtcttgccccatatgtgtttaagtaactacttttatccacctgcatttttctcatctatagtgtacccaacctctccctgaaaaaaagggggggttggtatatgaaattttgatgggcaagaaattcccaggaggcaaagaggaagattcctaaagagaatcctaaggatctggaaattcaggtggcgtctgtctgtgcatgtgtctcaacagaggttgagaatggaagctgccttgctacacaggctactggagggccccatgtcagttctcagacactaacgttccctttgcccattcttccctctcctaccagcttccaaagctttttactcaaagctttcatgctttatcttgaagagccataaacaatcctgccaacagagcccattgaggagtccttctgctcactgaggtgatatatatatccaaaggcagacttccttcaacacttgccttggcaccccctttgttttacaatcatatctggctactaaactgcatggaattcagactgtcccagccatagtctctaatggatagctgaaaatgggaaagtaataacccagctgtcggccgggtgcggtggctcaagcctgtaatcccagcactttgggaggctgaggcgggtggatcatttgaggtcaggagttcaagaccagcctggccaacatggtgaaaccccatctctactataaatacaaaaattagccaggcgtggtggctcatgcctgtagtcccagttactcgggaggctgagacaggagaattgcttgaacccgggaggcagaggttgcagtgagctgagattgcgccattgcactccagcctgggcgacagagtgagactctgtctccaatcaatcaatcaatcaatccatcccagctgtgctgagcacaggtaaagaccttcccttttgccaggaacactgaaacatgtaggtttatgagaagacaaaacctggttgtagcataaccagggtcatgccaagtgtgccaaatttcagaggccctcaaataactggtcctaccaccaattttcctgcagaacaatatacatgctttctctctgttccttcttcccctctctggccgcaatcctacaatgtccatacttccagccatggactcaagagccaaacgaaaaaagttctaaggtttggccaggtgacagtacaaatcagcccaaacacctacactttctacattgaatgtaccatccacattgattattccgataatccatacatcaataaacatttaatacattaaattatatcccccactctattcactaatgaacctgagaagtaatgagaagacaaaagtttttctggttaagaaaattcaactgattacagccattacagcattttgggtctctcaaggttggcctctgccatgcaaaaggcagttccatggtgatcttctagacaccacgttttcctcccaaaccttctgagccagttcaactaccttcctcccagagtacatgtacatttcatggaaacttgggaagaaaccatcagctgactggggtgcagaaaatttggaagccaacagtggctctgatatattcctaacaaacaggttttcatgcataacaaaagaaatgtagagttctactccagtgctcaaaacctcccagtttaagtaattttcatatataatagaaacagaagcgttccacattgatgctaaaaatgttcaagcttaagcacttccaaaataacacagttgaaaaggagtagccttgagaaactctcagttcattcaattgaccaccatttactaaataaacactgtacaggatccatgtgctgcatgcttctgagatgcagagagccagacaaaagttcctgtctccaaaaggcttatgatgcagaataaataaccctttagaggtcacaaaagccttagaaatctaatacaagttgcagactcctaggaaaatactttcacagaaagaatattccagataattttaggaaattacaagctccccagaaggaaatccatgtactcaagtgaactgcccttgatctactaggagaggtaacatataggttcataaatacatagttccaagctcttcctagtttggttcattattattttggattatgttctaatgcttttcaagattctatgaggtgagtggaccctaaagcctcaagggcacaccttatacagcccgtgtctgagatacgggactagtctcccactctgacatttgggaggggctgctgaaatatataatttcttggtagaatctggagttataaggaacaccatcctgccacttacgccaatccctgcaggtcacagatgtggaagggccaatataacaccctgtgcagccaaggtcaccctttgctaagttcttatgggaccgttcatgccaattcatctcttgaagctacctgcagacaggctcacctaggttagatcgatgccccagacacattctgtgtgctggaaagcagagagattttatttatttatttatttatttatttttcagagggagtttcgctctgttgcccaggctgaagtgcaatggcacaatctcggctcactgcaacctccgcctcccgggttcaagtgattcttctgcctcagcctcccgagtagctgggattacagatgtgcaccaccacgcccagctattttttttttgtacttttaatagagatggggtttcaccatgttggccaggctggtctcgaactcctgaccttaagtgatctgcccccatcagcctcccaaagtgctgggattacaggtgtgagccactacgcctggccagcagagatattttcttagcaaaagtggtgaacctagtttctctgagacccttattcctaccgccttggcattgctcactttaggacttctttctgaaaagcccactattccaggtgaaagtatagatttgccgatacctaggctcccaaggatgcctcaaatcctttacttttaattgaaaatcaatagaatgaagaaattcagacaaaaagaggagagacctcaggcacagacctccttggcacagaccaagccagtctctacatccttgtggatgagactggttctgcccaaaacattaagcatgaagttaaaagccagctgcttttagggctgagcagtctagctagttggtatatctaaagccagctgttccagcgagaggccagttgctcacttcctttcctgtacctagacagccactggggcccactggctggtttctgcacacttacagccaacaaaccagggcgcctcttgccagtagagtttcagagttgggttccccaccccactttacagtcttctacatatgccagggagaatactgggccatggcgtctttttaaaaggctcagcttcttctctccttgtcccatttccttttctttctttctttttttttttgagatagtctcactttgtcacctgggctggagtgcagtggcacaaccatggctcgctacaggctcaaactgctgggcttaagtgattcttctgcctcagcctcctgagtagctaggactacaggtacacaccaccactctcagcaattttttgtgtgttttgttttgttggtagagacacagtcttgccatgttgccctggctggtctcgaactcctggactcaagccatcttcccactttggcctccttgtttcctttctaaaactgcttctgtatggtagttcattcaatttttaaatacatcaagctcaaaagaaaatactgtagggccgtgttaacattcatgtaggctggaaacaaatgtagctcagaaccagatttttgaaactgaggatgagaaagattgaaaaggtagatgggagaacaggaaacacatgaagagttatacacgtgtgcgcagagaggtgagaactgagaaggagaatgaattggagagaaaaccttcattagactcagagagggaagcagtggcagtataccaaggtcacttctaatttagaccatctaattggcaaacaggctccaaatggctatcatctcacagggcttggaattaatgaaggctgattattttcattaccttcctcttaagatacaggcaaagtgagagagctggtacccaggtgggtgcaaccgcccccaggccagtggctgccctagagccccagataaccagcctgtcctagagattcacagacacacatgaagcatagagagtcacagacgctgacggaaaaaaatcacaaggttacaaactattggtctcaaaagagataccgagaaaagtgcaggcaacacagggccaggagcatggaagggaaactgtgcaggtacaaaaaatacagaataattaagaactaccaaagggagccaagacaaagggctacagaaggtgttcctaagctgcccaggagccaatcccatctccattatgaggtcatattttgttaaatgatgaaagaacaaagagaatttccccatatcagtgcttcaggatcccagtggtgtgtcctgtcacttagaaagatagtgatcaattagaataatttaagagtattgaaatgcatggtaggtggtctttcctattctcattcaggggacagaaacatgggccccatgccttccacccttctttcctgaaagaatgggaaaataagggcaccgagcagcagctcctacatctctttcaccaatttgaaatctcaagcttctttgtaaataggtgagagttcttatgtgtaactgacattgggggagggctgcccagccagttgtggaggggcccttgtctcatctcccttaagctttatagatttccttctttgatatgacgtgtgcagaggtactctttgcagctctgtttccaataggccaagaagaatgaagtgctgtgggtgtggtctccatagtggagggccagcactgcaattgttcctagtggagaatatttctcaagccccctcatcagtaagaagggggcccatggaagacatagatatgagatgcagagcataagcaagcagctgttaccatagcaacagacatattagacactgcaggttcctgaaagctgtctgataaggtattattaaatgaagcctcctcaaaacgcactccatttacaactgaacagaaagacgttgtgtagaaagtaatctgtttccatttatcagggtggaatttacttttagtgggactgaaccgaactcaagctaaatcctgagactttggacacagacagcaaaaaatatttaccagaatttacagctgtaaataccccggacacaccccatgtctgccaggaatcatctatttgggggattttgcaagcttttcctattctgcagccaatggcaactaactcagtcaacccatttggaaagaaagaagattcactcttgctgccattcatcctagccactcagggacaaagcagacataacttccttctcctggagcatgaatgaccgtagaactggccattccttaatgatatggtttagaaaatggagccctgattagaggggcatttttcatcatgctgttttcactttcctgctctagttggccatgaacaaacatatatcgttagaaagcctaaccaatactttcccggggccaatcttctaataaaatgacagtaaaataccctcccgtggcatgattttaaccataggttcattataatcacttagttgtgaaacaattgcaaattccatttttacaccaaatttttcagaggaaagacactggcatctgctttgattcatcagagcagagatcaagatcatcagtattccagtcctcaaatacgatctcaggttcaccttgtggtaggcccacaaattccctctaaccctggttgctcattttttttttcctgctgaactaaaggcctgagatagaaatgcatagtttggctcaatgcaaactatccccatgactggacaaaccagttcaatactgacagccatgccataactccatgcaaagagaaaactcatccttgcatatacatctttcagtaaaaagtaaaatacttatatgattacatttctcataactttcaactttattcctgaatccattgactttcccttgttgctaacaagttgacttcctattacaagtgcatttcccacaatctgcacacttctcagaaatgtctagaaaacatctccatggtctgctgtggaaagatgaggaacatagaggtttctatacaaggtaccaagcccagcagtgctttagggagcagtgtctcctacataattacattgtcaggggttctagaacagtttgtattgaccagtcccatggacatatccttatgctccctggcattgtacacacaattttatatttgcaaaatacttgacggagggtcagtaacagtggttatcaaacattggtatgcaaagaataatacagtatggctgttgtatagctttcatgagagtctccataaaggttaagaatcactgcttccaaaggtgctagttaatgggtaacttccagaaatctcttagggattggcacccaagcaaacacagaagtaatatcctgcccttgaagactctgttggtaaatgaagattcacaatgaccaccacacttgtcacttgaaatttaccttgctattgctattatgaaaatatgacaaacaatgaatatttgaaatataagttatactctagtccctagggatatataaatgaaatttttactaatgtaaaccagtcatgtagattactataggcccacagtccctagactagatttatattaaaatagcaaaaataatcacctgagtaaaagaaaaatgtaggtcagtattgacaatgcttccctccccacatctctttctgttctttcaggctcccatggttctaggccatcagatgggaagtacaatgaggcctgttacttccaaggatgatgagaaagctgaggaaaccagtaacacagaaacccactggtccacagaaggaggttttcacttacagagaatctttacacactgttcaccagctgatttgaaaatacccacagaaagttaatttaacttcaaagatctctgaaaggcaactcatggctaggtcacctttgagcttcccattggctgctaaagttctcttgatgcatcatcaattatatattcttcatgactaaacatcacttacaacgttattcattaacgtttgcagaaccaaatggaatagaaaatgcctggaggtgatatgtctgtgacctgcacattataacgtgcagttgtgaacagactacctctctgggaatcttcacgtgaaaaggcaatcaaattaacttattactccactgctaaaataatgctaagaaagaggtgagaataattctctttggtggtttttcctctaatgatcaggaaagggcttttttttttttttttgagacggaatcttgctctgtcacccaggctggagtgcagtggcgcatctctgctcactgcaagctctgcctcccgggttcacgccattatcctgcctcagcctcctgcatagctgggactacaggcgcctgccaccacgcccggctaattttttgtattttatttttcagtagagacagggtttcaccgtgttagccaggatggtctcgatctcctgacctcgtgatccacccaccttggcctcccaaagtgctgggattacaggtgtgagacaccgtgcccagccttttttttcttttttcttttgagatggagtcctgctgtgtcacccaggctggagtgcagtagcgcaatgtcagctcactgcaacctctgcctcccgggttcaagtgattctcctgcctcagcctccttagtagctgggattacaggaacccaccaccatgcctggctaatttttgtatttttagtagagacagggtttcgccatgttggccaggctggtcttgaactcctgacctcaggtgttccacctgccttggcctcccaaagtgttgggattacaagtgtgagcccccacgcctggccaggaaatgactttcatagcagcaccaacatagtcaaaagtaggacatcaccatcactggcactattttgaaaagtttttatattacaattagatttacatctttacactaattaggccatgtttatagtggtcacttaggggcatgctttcaaaatctgcagttgtagcaatatcatgttcaaatgcaaaacccacattcacgaatcagcaatatccagctcaccattttcttgctttaaaaatcaaagtatccactgagaaactccctaccctagagttggaaattgcgggttcaaatctcaactctgctccttacaaatggcatcaagtcagttaacatctttgagcctcagtttccttatctgctgatgggaatgtgtcaaaaaaatttttttttctttctttttttaaagagatagagtctccctctgttagccaggctgcagcgcagtggcctaatcatagctcactgcaacctcaaactcctgggctcaagtgatcctcccaattcagcctcccaagtagctaggacaacaggtgcatgcaccactgtgccttgctaattttaaagtatgttttgtagagatggggtctcattatgttacctaggctggtctcaaactcctggcctcaagcaatccccccaccacggcctcccaaagaactgggattagaggtgtgagctagtgtgcctggctcccttttacaacaaaaacagagtttgttatgaggatgaaatgagacataatgaaggtaagagcaatctagttcatgacctgctcagtaaaggtttgaagaatttgaataatgatttcttcatataaatggttagctaatccatgcctctgtcccctgagggcagagaggatgataagggaggttgagaaacacatgttcagcactttgggctatggtcatgccaagtctaaggcagggatagtacaacaaaggtcacagaacaaggactgttttctgacgtttccaactctacactgactttctcgtccaataatacagtatcttgcccatgttactgcatcacctttgaccctggagaaagaccacagggtgctgctcctggctgccttaccgtcataatgagcttctccacgcagtcaggtgccacgctgtggaggtgggtgaggtgcagctggaggtggatcttgttgttgagcatgtcctggcacagggggcagcgaagcatgggttgcaccgagtgctgcgtcatggcatgcacccggagccggttgacatcggcattactgtacttgcagtagggacactggtacatctgtggggaacacacccactgctttgagcaactgtgtgtgccccaagcccgcccacccaaaagtttgttccctaccaatgtctaaaacacctcacctccccaccagcagagtcccttccagcctcacctgctccggtttgatctcctcagctgtttttggtcgcttcgaagagaggggagactctgagctacctgggaaggagatgcgtttggaggttgcaggagaatctgtcagctccttctctgcttggctggacgatgctaaaagagaaagtagaagatgcaatacagcagccagaccaggccagctcccagagggtttgtgttgggtgaaaatcaacattcatttatagcacaggattttcttaaaacaccaaaattcaagaaggatgaacatccggactgatttatcaagcatgttggaaaagaagcaagtgtttctttctcccccatgaatttctgtcactactttaacaactgaacattaggaaaagaaggcaaagaaatggaataaaaggctctggagttggattaagctaaattcagtctgttctaacctcccccaatctagatacaatctgctggcttgtggggggcagtagggctgagggtgggtgggaaagtctcaccaattgctttgccagcctcagtaccagacatgctctgcttcagaaatgtaagaagagatgtgctctcaactttattgtccctcctcttggaatcacaacatggcacagcattggcaacatgaaaaatgtgatttgagaaaggttcacatgagtatcagcacaccaaatatgtgggggaaaaaaatcaagtttgggttcagcagtttgcttttggggaagaaataattgaggagtggaactaggcagggcctgaatccaagatataatctagccagtgctccagacccaagagtttattcagagtgggtgggaatagggaaagtttcctatctgcttgcccaaaccatgcctccatgcccctcttgcttacaccaccaaaaaaaccaaacgctatttaaagaggagtggcccatgaggattgagcagcagacagcacgtacggaagtgctggtgggaggagttctctgaaggatggaaaggaaacatttctttatcttctctatttttaaccccaatcagtaggcattaggttaggctcagggtttatagttaggaaaaacctgctatctgctcctccttccagtagaggcaaacactttgataagaaaacagccaggctaagggtttatccaggataagcaaggctcctccagcttaaacacagtatggttggatctggttgttccataacctggtcaatatctgagtgttggctctttcatttgttttgaatatgggactccatttttcagaattttgtttaaagcaataagaaaaaaaaagtaataaaagtggtagtgagaaaatatatatacccacttccctcatgaaaaaataatgtgactcagcattcaggtcactgaattagaaagcccaatttttattccctgttaaactgctttctgttttaccctgtctagttatctggcatatatttccatttatgcttgggtttgaaatttgttctgatgtggacaccaagatgctgtcattactttaataaacaattttagacaatcaattttattcattaaaatcataaggccacaatataattttgaaaagaaatttgccaaatgcaggaaatatattccaggaagttgatgctcttcccagagtgcacatcttgtgacctttaaccccagtatcttggtaacctggtctacataagtttgtaggacatctattatttaaaaagtacaaggacgagcatattacacacagatcctcctcctcccaacacacacattcataacagtattttaatctgtctcgaatcgacttcaaacccattttgctcttaatgggagttattcattttcacttgaaaggtaatacatgacggctggatgtttaatgtgatggaatggctgccgattaactaggtgctgcaacattctagaccagttcccccatggcctacttcccatctcctggccccgctcagacctgatcctatggaacgtcgcgttgcaggtttgagaccttgcagtgtgatgggccgctcctgaacacatctacatttggagtccttaattaatgtttcaggaacttaagttcccttgcccccagaaacttccttattctccatcattttgatttttgcttagtggttatcttctatatattaactcttcaaatgcattctcaagatggggtgggtgagggcatcaaataatacttccagtgtttatttgtcacagccatttctttaccttctctattgtgaactccaatcagtaggcattaggttaggctcagggtatatatagttaggaaaaagctgctatctgctcctctttccagtagaggcaaactaagacatagattctattccatacacccatccccatccttttgttactctgcctgactaaaaacaacacctgttttacaggactgtgactgccttgtaaatgccctcaatctgcctgccccctactatggaatgagtcaattgtgcacttgctcaatagtgtggatgaatgggcaccgaggctgagaccacccgactcatctcactctcccagagctgaaaagcaaacacagtaacccagtgcagcattagtttcctcataggaccaaagagtccatcctcttccttgaatgctgaacacatgatgaattgtggtgaggttgcagaggtgagaattctggtttcagaagccactattctttccccctgcatggagaggggaacttcttttttttttttttttccaaactcaaactgctctggaattctaaagcttcttttgtgagcttgagctaaggacccattataaagtgttttaaaaaataaaatcaccaattgctcactcatttttctttcttcccagtgatacaacagccctgctttaacatgaaatgctgcatccactggtgcacaaacttcaggttcatctagtttctatctaggacaatctgcacctttattagatcaaatctgtctagaagtggatattagccacctgcagctcactggccccttctctaaagataaagcaatgccatccttataacagattctataaacacccagttacaatctcattgtgtttgcctgagtgatgtggggatggctcctaagagttaactatggctgacacatgcccctcccttgcttgacctcagacattaaaatgtcagtccctatcaagacatcgtaccaaagtcgttacaccatttctgtagatgggcaaacagttgtgcaagttctggcaaggtgcagtggctcacgcctgtaatcctagcactttggaaggctgaggtgggcagatcgcttgagcccaggagttcaagaccagcctaggcaacatggtgaaaccgcatctctacaaaaattacaaaaattagccaggcgtggtggcaagtgcttatagtcctagctactcaggaggctgaggtgggagtatcacctgagcctgggaggttgaggctgcggtgagccatgattgtgccactgcaccccagcctgggtgacagagtgagactgtctcaaaaaaaaaaaaaaaaagagttgtgcaagttctccatcaacatgctatgctggatgagggtttatcacagaccacagtcagaggttctctcaagtttcttctctctgaacagcttcaaaagggccagagtctcagaatcaatttctacttcagttctgtcactagcatacatcgtgggcataagtaaatgaagttgtatgaataccaagagagaaagtactgtggtttctcactttgaaggcttttctaaacttaaactctagaagacatgtcacaatatacaaaacacttttaaaaatcaattactggtcactttaagcctgcgatgatgtcacataagtgaaatggaaatacatgcactccagagacaagacatagtttagacaattggtgtctggaacctttggtttacatcggcaacaaaaaaacaaacaacttgaagcgttagtaactctagtggtttgtacaataatcacaaaatgatttggaaacaatctagatatcttacaatagggcatggtataagtaaacaatggcatggccattctactgagtattagaagacattaaaactgattgctatgaagcaatatggaaaaatcattgagaatgcaaatcagaaaagaagataaaatgtgtattatcccatgttacagctatgtaaaaagtaggtattagaaaaaaagactagaagaaaatgatcattgcctttaggtgatgacatcatggaacactttaagtttttcacatagtcattttatttttaatattacagttatcatttaagttcaactgtccatgaaaaagttggtattggctctatactgtgcaaaacatcagatggtattttttactttgctggtaaaagcaagttctctcattttggcagttataaaatatgaaaatatgtgttaaatctcagtgaatcttccataggcaacatgttgggctcctgggatttcaaaggggataaaaatgtggtaaggaatcatgcgactgaatgcgctatagatgacaaactctataaagctaggtaaatgggatattgtgacaacgaaatgctgggtcaaactcctactcaaacttaacaggacgtgagctatggattccatgccacacagactttccagggagtgagaaagcacttgctctgcttgttagtgttatggtggccctacccaacgcgtgctgatgaggcacaggaaagactagcatgtccctgttatggagttcagaaaattcaaaagtcagctctctgggccaacagccaccacttctcctcattctgtgatgagttggccaactaaaactcacaaagacaaatactgagagaaacaaacctgttcatgattgtctattttatcctcttaggctcctctgcattctaggcaaaagaatttcatttcaaagggaagcacagttgtcaatacatggctcccttagggggaaaatcatttatgcatggagacaccaacttccagatatcctttgattttatcatatttgttttagaagtattaaacctctaaaaataattactttaaaagttacccctctactcatgttagttagagggaatagggaagagagctgataagcattcatgcaaagttttgtttggaatttgcaagaaatggttttattacgttgtaagcatatagaataatgaaaatatggctagcaaaactttgtgtaggaagtgacttactttaaggaacagtatcacttagaaaacttgtcaagtggacaaagatggtagaagcacagcctttcaacattcacagtcccttataacttcatctgataaaaccattcttgctagaacaaattctcatgtgatcccaatctttgctaacaaattcgacatccgaatcactgaaattctggccacagaaaacttaagagttgtgcttgcaatcccagtggacttaatgccaacacaggcttcatttctcatctagtaactctgtacaactctgaagccaagtaaggcgtggagttgctgcttcatcaaagataagcctgaagaaaaactggaaatgaagtaaaacatggaaccttaaggtccctcattttcaagatatccacttgccctccaagaaaaccaacatactggtagaattagtttctgtgtttcctaagcaaaattcatcttctcatcactaaacacaccagtgcgctgttggcatggctgcatcctacgatgcagaccattctccctctggccagaggcctccctcccttggggagatcctgggcaggcattaagctgtccacgttactgggaagtttcttttgcatctcttcatggtggagtgactcctggaggtggtaatcaccgaagtgctgatcctcttcctttttggcgtcctgaggtgagcccactgagggtctgggatgctgcctgacacttgaaccttgtggggaatccaaaggcagccaccacccccacctctcaaccatcagactcttagctaaaaagtaccactgacagcccctccatctaaatttccatctcccaaaccagcaacataatggaggagccaattaaatgattattaattcatgctactttccgtaagccagaggttctcatcgccttacattccgtaaaccagcttgccacctgccccagaaatttacagcaatcttttctctatctccgttgactagcgaaaaaagaaattcacatagctccatacttaatgtctgagttgggataactattccaacacacaagacacagatgtatcaccagatctgaaaatggtccttcagctcataattataattaaatggaaggtgaaatgtgtgtttcccatagctcctctctctcagcttctcatacctcatgctcccactagacagcagaaatgcaatgtttccagagggtcatctgtgcttttggattttgtgatctgactttcattgaaagtagagttactcttggcatttgcttgcaattccttccccagaggacaggctgggctttcttacttgaatctcctgtggagctactgcacttgataagtggccaaagatctagctaaattttcttcctccccccaatagagagaacaacagttcctttaaagaatctgctttcctgccaacttggtctttaaacatgcatggtctcattctgcctccaaccaagcacttagagatgtttccaagaggaataggggaagaggggaaggggatttgtgtgaagcagatgcacgcacatgttcactcagcagggggcggtcttcaggccacagctaaaaagaaactgaggcttctctcttccctaatcaaagaagcagaatctgtctcaacatccagcctggtgaagttaagaaccttctattcaaaacacagtcttattctaaggaaatgcaagctatctcgctcccgtatatccctagaaaacacctacccctaaaagtagaatatgcttacaaaggtatggcaagacacagaggttctatcaacttcacaggccttttgtttctaaaaagggtttcaaagaaaatttgatttatactacacataggtataagagttactcagggaaaggctatttttcttctccaacttaaatatgaacaaaataggtcagcactttaaaaatccagcagctcttagttgttattattacgattttactttttgtttggaaataattatagcttcacaggaagtctcaagaacagcatagagaggacccatgtacacttcacccaggtgttacttattaagcagtttagataaagatttccaggtcttccatcactcttcatcgtgaccctgcctctccggctccctccctccctccctctcccccacccccaatcttgcttacatctaccaagacttagggccctatgcctgtcatacaccttccctgtcctttaggaaagctccatgcctccctaacccagcaagggctcaggacttactgtctagttaagaagtcgatctcaaaacctcacgcttgtcactgagatcgcagccttgaggttcagcaaatgccagaatgtgtcagactcccgggcagggctcattaaaacacagatcacagcccctgccctaaggttctgattcagtaggtctgagtcagataatgtacatttccagtaagttcccaagtaatgctgatggtccagggacgacactttgagaacagtggtcagagccaaggctttgtgtaataggtaggaaccacgctgctttgtggtctaactagaaataaatgagagggcccagcaagcatgggccaatctgtcagtccactttaaatggctctgatgacatgatactctcatctaaactcagggatgacagccaggtttggtctcatagcctagatgttttaaaacaccctcaggccacctgcttactctaaaacaaatgcagacaccttcaaaaccagaaattcagaaggaataagctccatgtgttctgttagcgtaatccagaataaggacagacttccttgtttacagaaatctctttctttccacatgtcctgtcctggagagcctctgtgaaaagagggcaaatacctgtgggctccttccaccttgcagaaagaggaagcgtctttttagtgctggcttccctcggtcaggcacctgcaggcctcagcagctgaaggccctctttgcttcagccctggaagcatgcacagatctatgctagcccccatttgcacaagtcagcaatctgggaatgggggttcaggcaccattctgtggggcctctgctttctctgcaggaagcagcctctctggcaggctctggaagcctcaaggtgggatggtgggcacacgctgaccggtgggtgctgctgcttgctctgcgtattttgggagaaaaatagtgctaagccctacatcagagacatcaatctgttgcactaattccttgctgaagtatgcataaggctgcttaaccacactgatttgagttcccaaaaggccattccacatttcaatttcaagacaccttgctccctctgtgtcaggtttgcaaatgaaccaccagtcaaaacagagccaccacctggtttagaccaacatcagctgttggtctgtttaataaattataggcactggactgccaccgtgagcccggctcatgccaggatttggaggcctgctaaatattcctgattttgattttgacctgattcctgactttgaggtactgagtcaacctgcctgtctttggcctcttgttggttcccccaaaatatgctgtcttcccctggcatagcttactgcagctatggccatggtatcttgtgaggatgggtggccacagtccagggacacactagggggtctgcacttattacgcttccctgtggctttattacaggactgtgaagacaaccagagtgggaaggaacctcagaaacctttggaccaacagaggaaaaagcccagaggtgcaggacatagatcaaaaccagtcgcatgcgagtcattctaggatccggccaaagttaattaacagagggccattcagtctccaccgagtcaaacaataattaggttagttagggtctttgagccccaacacagtctagactctgagacactgcaatataacaatattcttctggtttcttctccattccaaatctatcttcctaaaatactaaattttaagagtgaaagtgaacttgtgaacataaacaggtaaaatgtgggtgtgtgtccagaatggtgacagacagggagaactgctgaatataacttatcagaaccttacaaactggccttccctcatgatccacctagggtttctttttactagtcaggttccacaggaaaatgtgagaacttatacttagggaagaaagacattactcaggtccctgcaaggctggaaaatgggaatgattctccactttcccctccagatttaagcactacaaagactgtcaacatctcttggcattttgtacagtacagagagatagacaccctacattgtgtaatgtttatatttaatatcagtgctgctttccgtctccattgagttcccacattcagctcactcacagcgctccaaaggcctaggataagtgacctgtgtgaagacatggggaggcggttctggagcaccttcaggtactcctcaggaactgatgttttttcacttgttgtttgcctaaggccaagttctctttacccgaaggcatcattcagccccccttgctaggtaataaagcacaatattttgtagcgctggtcacagttggttcacatcctggctgtgtgacctcgagcatcctatctgactacactgagctttctgtttcctcatctgtcaatgggataacactgtctacacatggtttctgtgccgctagccagagatcaggcatatgatgcctaccacagagtctggcacatagtgaaagcgcaaacatttgttgctatggtttcttttttagaaggattgggaaataatactgctggggctataaaaccatagaacgaggggagaaacttgtttatttttttgtttttatgggctttccaatgaagagcggaaagcctgctagacaaattctaaaagctgtaacactgaaacttggtttttaagacaagcaaagacaccttaaatttgtcttttctctataccaggatgaaacaatcctattaacccatggatttaatgtctacaaagcagaaagtagaataacttggacttaaaggtacttatgtcatgctattttaccaattgattgttaacgaaacatctaaacagtattaagcacttgctaggtgctggggattacaaaaatcaatggttgccacatagctcctaaccataaacagctgacaaactctatctgacaacaagagaagcatagaatttaagttctcctcctccaaccttcctaaaagtagagaaagtgataatgttacatgttctttggctttataatgtagaaaatatatctgactcagaaggcaaattgggatttgactgcaactctgacacccgagttcccaatctgtgaggcttagttctcgaggctgcaaaacgaaggtagcattggacccaagaagaatatgagaacctaatgaacgtgctctaatatcccccatggaaaggcacaatggtattttttttaaataatcatgattataataacagaggtactttacaattggcacaaaagttaaagctggaacaaagcaggcaagattaacatggccactctgtaagaataatatgcaaatctataaggtattttctatagtgatgaacaatgatttgctccttaatctacattttcactgccctttatctataccttgatgatagttctcattatactgtgtcataattgtgattacatatgacaacacttctagaaagtgagtttttttttttttttttttttgcatgtcctgtacctgccttagatatgtgtgcaagaaaatatttgttcaactgatgtggtccctatctctcttatgacttacaacataaattctcaaagccaagacctttgaattaactggaatttgggcaagtccagatatacaccacagcctgtatctattttggcttcccaacataaaaatagttcatgatttgttttcaattgtgagacagaattccgcctgcagtgactttaagcagccaagtatactgaaagtggcctggaaaaaaaagagtggggagtgagagaagggggcacaagctgactctggaaaaggtgacacagtcacacaattccaatctacgtgtgaaaacataaaaccaaaaatggtttccattggcaggaccatgaaccacaaaggggccacgcaaaatgggctcccagtattccctcacatgcatcctactgcaaagacaaatttacttttgggtgaggtggagaaatgaaaccaagtaccagaaagatacagagttaggccaaaatgatttttgtagaggtatggtggtggtgttgaatggcctggtttctagtcaacaacagggttgggatatgagtggccactcaaaggcacccatgtgagtctccaaggactcctctgttgatgtcctcatcacactgcctctgacaacacagtgtgtctgtcccaagaacacagaactaggtaagggcatatggtgctcagacattccatcaagaaaagtagccttggtgctgcctgacctccattgagaaagccttgagccttttatccagggtatattaactagccacagacaagagaaatctgggaaagttattagcattccaactttagtaattaatatgctccaagattctataatgctctacaactgtccctaccccagtcataatttatgaagctccagaattgttaataacccatttggtccaacctgccactttacagatttggaaactgaggtccagagacctcaggtcacgcaggtgaacttagtggcggaattaggccttgaacccagggcttctgactcctacgagtcctgtatttttcctaacacgtttcctctcagcacataccttcttttgtccttagagactcaatttggaaaaacgaaaaaaaaagtattttttcagcccctttccattctttgtcacagattatatttcaggcactaagttccccatacaaaggcatctctatttatacaaagctgtaaacaacagggaaaacagggggagggctggtaatagatttgcaccaggatgtgcctgacctgctttttttcaacctcagtaattagaaaggcagcaggtctgtaggaattattcatatgcagcaggagccatacgctatacatttatgttaaacatgtcaaatccgattggaatcatgcctgccagcaccatattccataaacgtacttttccctaacagtcacccagaccttgccagcccattaatacttcctttaatagcaatcttctatagattcaaatcagggacgctccactgcactaattgctgtgttaggtgagcatcatagatttaaaaaaattaataaagtaaaatcccttcaggccaatcctttagaaaaatgaaaacactcaaactaccattctaactcaaaaatttacaaaaatatgaacgtcagggatttttgaagcattattgtggtgtcatttcaagttgagctatttccctgcttcccctccaacccgcatttttcaaaagcaccaataccctctggtcatctcgtcccaaattaccttaactagactcagcctggtactctgtggctggaaaccatgacgactacaggaattaaataaccatcttgctatgattctttgccaagagttcaatttttcccctaattattggtgataaagcatcacattaattgtatatcacttaacttattgcaaataatgattaattggataatcactgcattaatcattgctcagttgctgacacggggggctcttcattcgagaatacacacattcaaatctattctggtaaaagagaacaagggtcattttcatgtttcaaaagagaaaaccacaaagttggacagtggcaatggctgtgcattagggaagagaacaaagaaccttcctgtacccttcactggcccacaggagtacatcacactttccttgacaagatgtgcccgcaagggcctgttcatgtgctaccactcaccctcttggaactctcaggcggttgggactagtggatatcccctgtccatgtttcacagaggaggtacctgagccgaaagaggccaagtgcctcaatcaaggtcatctgctggctggtgggcttcctgactccaaatctagagtctttccacatcaccatcccgctttcagactgagcacaacgccagctccttacaagacatatatccatggttgataatccagttcattttgaacatcctggtggttatcgtgttactatgatcactgtacaatgtcaggagactgctactccttatacttagacatagatgaaaactagatctaatgatcaaactgaaaatgatccttctctgagagatggtatattggtaagagcttgggctctgtcctaagttagaataagtgcaaaagccagtgtgtaaatctgaacctgtctgtataccttttggcgatgtgctagagattcttaccttcctttttttcacatcatggcacacacagaaaatgatggcaaattgggataaacagatgaagcaggacctgtgtacctgtgagcaattcatggcatgcctgctgggaaggacaggtgtgaagctctagaatggtgcctggcacagggttagagctttatgcagccgttataattaccagaaagttgctgtacctatgatgcattctttcagggttagttttgttcctttggggtatctatagctgcacatgtggctacttaaatctaaattcattaaaattaaatacaatttaaagttcaattcctcagtggtaccagccacactttgcaggctcaatagccatatgtggtaaatgactatggtattgttcagttcagatgcagaacatttctatccataccaaaagttccattcgacagcactgatctatagtaatatcggtcttacgactacgggcgttcctgaaatccccagaagaatgttagattccctgaaggcaggccctataatctcactgaatttgtgatcagtggaactctgcccagtgcctcgcatggggtagggactcagccattgatcgtggaattgacccaacctcagttcagatcactatcttgcttgctgtgctgccacccagggtaaaagacctgacatctgaataaaagaatcccaaagaggaacccccaaaaaggaaaccaggaggcccactccaaatgtagaaataaatagctgaaagtgttcagtacagagtacccattcctgcacaaaccccaaaactacaaaatcagtagctgagaaaatgccaattatccaggcccatctgaaatattattaatctgcatcatgaacagccactaatcaacataacagattgtgaaatcactatttatttacttgccaggaggaagcattccccgtcacatgtaatcagataggaacagctcaatttagggagagaatagaacaaacgtagttttaaaaatatatataaaataataaggatccagaagaaagctcagaggaggttgctggcacctgtatcgattccaagatcaaatcggcccaagtaccttaataaagcctgtcattacacactcagatactatagacaaaattatgcttcggatcaaaagaggatcatttgcaggagtcgggaaagaattttcccttctctctttactattgtgcagctggcaaggtgcatctctgagttattcattcaatcactcattcattcattttctctctgtcttttggaagtaaagattaagtaggcctggtgcttgaatgaatgcatgagaaagtggaaccttattaaggacattcattttttatggtgctcattttacgtcttttagtagtctcctgattgcctagcatgtccactagtgctgtgaagacacactcccaatgaatcagaaacactctgagtaagatttaattgaactgctctcaacaaaggctgccctaaactggttggaaggattagagaggcacatatagagtggctagcataaggcagcacatagagtagggactttgcaagtggtggctcctgtttattatttccgtagtgcccttagcacacaaaatgcacgaaacatacgcaccaaacatcattcgcacgatcccattaaatgcttgtatgttgcttctccctcagctcaaaattcccaggagccacatgctgccttgcaacagaggacccaaagagaaactgctaccagttttcctcatcttatatatcactaaaccattaaacaaacaaacaacttacatagagcttacaacatgccaagcactgttcggagcttcccatagtcaaataatcctcgtagcaatcctacagaaataggtactatttttaatcttcatctcatctgaggaaaatgaggcacagaaaggtcaaggtaccttgagtggggtcacacagctaatgagtggcagagccaggattagaaatcaagcacccaaatcgtgacaacaaaggacagatggctcagaaggtcacccagtcttcaaactgtgtttgtgaaatccttttccccagctcacctggcgatctgtttaattgccgtgtgaaccatttgtttagctctcattcaacgttgaggcaaaactgggatcttggtccaggcaaagccccacaggaggatacgtcccccactacattcagggccttcctttgagcacagatgtccatcctccactcctcggtcctaccttacacatcgcctagggtgtttgaccctcattgttttctggagtttaggcttctggacaccacacaggccagtctgaaggggaatgctaagcacagtggacagtagaatccacctggtgtgctgcccattcattcggctgcagtatggccctctctgtgtctcccaggaaacactgaacagtggtacatcacccgccctgcgtatctctcccgatatctgggaactattgtactacctctctaatttctcttttctaggctgaatgacccatttcttcagcctcctctcaaaggcaatatttctcagcccttcagtcattttcattgctctcttctggcctctctccaagattctgtatcttgtttaaatagtgaagtccaacaccgaacatgatttaagaacagtcatgcctggaaaagtaacaaaggcccaacgaatacggactccagaaagtaaacattttctcaaaaacaaaagtattgtaatattaataatggtagtaagaattaggttgaccaaataaaatcatttttgttgcccgtcacatcatttcctcttattattttctagaaggcttaactgtcccctaagtcttctctgaaatgactttgctcctcctcaaaaaccctaagcttttttagtctcagctcttcttcccctcaacatagaaagcttatcatcttgagaaatggccgttctccttctctcaacaccagtttttccagaaatagcacttcctgtcttggcttcttcaatgtcttctgctttgggtaagatgtccccctgcctggctgcactgcttgtctcccctttgggtggatttcagcacatgagtgctcaccctgggggagggggaggacaggaagaatatgcagggcaggcaccacctgtgcagggccctgcccaggcccccaaatgcaggacaaagaccacccttcactgctgactcccttagtaattttttatttttattttatttttattttttggtcacccaggctggagtgttatggcatgatcttagctcactgcagcttcgacctccctggctcaagcattcctcccacctcagtcccccaagcagctggtactaccagcgtgcaccacaatgcctaattttttgtagagacagtgtctcaccacgttgcccaggctggtctcgaactcctgagcttaagcaatctgccgacctcagcctcccaaagtgctgggattacaggcgtgagccattactctcagctgggaatcttttttttttttccccgagatagagtctcactctgtcgcgcaggctggagtgcagtggctggcatgattagggctcactgcagcctcaacctccagttgagggttcaagtggttctcccacctcagccccccgagtaactgggactacaggtgtgtgccaccacacccagcattttttttttttttttgaattttagtagagacagggactcgctatgttgcccaggcaggtcttgaattcctgggctcaagtgatcctcccacctcagcctcccaaagtattgagattacatgagccactgtgcctgacccttagagaatcttgaggctaagaatcaggggtgaccctgatcaagttccacatgacaaatctctccactggccttgggagcaggtgggaccagcgactggaccttcaatagaggaagaatgacatcaagggcattttggtgaagagccaccaaagagatgtgaccaacacccagatgcccttgcacacagcttggcacttacctggatactcaataagcaagctggctttggtgccacttaaaaagcttaaccattaaaaactacagtataatgtagtataataaagaagaataaaggtgactgctcaaagaagcaaacgaaatctccctcccactcatcctttttctgggcagactaaggatgtatccgctccctgacttgttagctccattcttccagggaaggaaagatgagaaggctcaaggacagccacacacactacctgtccacttgccctggtctttctcacctccgccctcttggtccttagcaagctcctctggatcagcagctgtttcactgggtccttcaacatcttcaatggcttcttctgaaacagaagaaaaacatgtcaagggttaaaaataaaaagaagatgaaggacttttggcctctgttgcaaacaactgccaacgacagaacagacaccaatgactcgtcccccttctctttccagaggcccctgggagactgacggtgctaaggatatactgaggtctgggtaagcagtggggactttccttctgggtaaacagttggtatgaggttgtgactcgctccagatgtgtggccattaggtatttccagatagattctgaatgcttcgcttgagtagttctaactgaaaaaccaatcctggttgaagcagtaactccacctgaatccctgaagttgcatgcaagtcttttacacttgaaaatgcaaaacatggccacctgttcacttcatgcctagctccattcccaaagcctcctggtactggcctagaccagccccagtcactgacccctcacagggctcacagtgcctatgcatgtgccagagtgtgtgggaattgttggaagtcatgcaggttgcgaagagtcacagaatatcagtgatatgagttcatcagtttgaagagttccagaaaccaaatggtatcttgtgaacatgccaggaggcagtggtgggaagtgagatttgtagagtaagggataaaaatttgtaacagagtcgtacactttctttttgaagcaattccatccttcactcactacgggtttaaaactaatgcaggaaacctctctccagttcagtacacagtgctacagtgaaggcagaatgacggctgccaacgctaggctgcttatgaagtcaaatgtcgttcagccaagtggggaagaagagaataagatactctagatgctgagggaaagaaggggagacacttctctcttgctttcctggccctccgaaacattatccaaaacatgcattcagtaagagtgggctaagggaatgaataaagtggacaaaccaaggtgaaataattttaataaagatgaaattattaggaggctgtgaagagcacattttctcaggtacacaggcgtgagggcaaggatgcccacatctgtcagcagaccagaccccagcaaggaagtactgggtctggcttagaacactggatcaggcctctatccagcaccgccagaggtctgtccaaccccaattcaacttttcagtattttaaagtatcatgccttctgaccctctagaaaacagcctctaccccaatgctacttttccatttttctaaatgtcatgccttctgactgtctagaaaacagcctctaaatgtatctcacgaaggaagtaacaggagtacaaagtaaattggtctcaaagggtttctaaaacactgaggaagaagatgtctatttagaatcagattgtcttgactcaagagatgatggaggtccaaggtctggaaaactgaactagtgtcacggaacgttctttcttccttaccaccaagagggagtttatgaggcagtcactgggaatacaggtgaaatacggtactgtttattttcatctccaactcaggattccacatataatttctctgtctccttctttgtctcactgcacaataaagtcaacatcaagtttccctaccctacccttagttcaaacagagaaaaatcaggcaaccacagcttgaagtcaatcagatatagagccccacattgacaccatacatcatttagtagagtaaacatgtataggtgtcagtagagtaataacaaattacacagcgtgacacaggaactatcttcattatgtccaggtgggacgttctgtgcacatttttaggatttcaataaaattgttcaacactataatgataaaattcatctttgaatggtgataccagcgtgcggtcaatgaatattattgcattcggtctacccagatgagctaggtcccttaaaggacccttatttgtcccaatacatgctgtgatacaaaatatctgtagtgttgatacatttatgcctattgttccattattggaacactaagcttgtaggagttatttatatcctactgcccaaggtcatcgccaaggtctgatttttcacacacaaaaaatttgcaatctccagcataaatgggataatcaaatttgattaggcaaagagatggctcaatggcctctcatctctagtgcatacatatgaccaccttagatgaagacagtctgatacctacaaactacagaacaccctgagatggtgatgtgcagtgtctgaaggtgctgctcagcagacatgggaagggatttacccactggggggccatctccaagccagcacattatacagcctgcagctatcacagcagagcactaaaaactcacagtcacccaacactgaccccaattctttgagccttaccaaacaaatctgttgagaaactagagactgtaatgtataagcagatcattgatgcatcaagcatggaaactgcatgttgctttgtgaatattcctggagctctcattctgtgagcccacttgggcttttgctttcttccctccctgccctactgcaagcagaaaatgaaggcagctgagttccgatgagaggatcaacgaaagaggttatttcaagaacttattttgcttatctctttttttaaaaagatttacaaatcaagtcctcttcttgagttcctaggtttaatattatcatttgtgattcattcactaaaaggctgttctatgcgtggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgcctaacctgagcatgtggaaataatatatgtcttcaagtgaactgtctggtcctggagaaataaaataggacattcataagcagttacaccatctgtctttataccatcatcatcaacagcaagaggaaaaatagctctttaaaatggatgaaagcccaggctgacagtaaccggaaaactgtgagctctgaataccaataaaggtagagaaatgattaaaaaacagagatgcaaactgaaaatttgtctggacagctcaggcccacgatgctttgcaggcagggtgtgttttattggttccgaaagcataaagcaagctgcttaccaagagccaggcctggggaagggcttggtctcccggccctggaaacacgtgggaaccaggggcaaaatagcatcccgctttgaaacagagatctgcgtccacacgctaagctcctagggctgttatctagcccttgttctctttaggaatgtagatttgatacacacgtgctggagaatggaggggaggttttttgcttttccccccacagatcatggattgcattcccccctcttctgcgaagtcactggtaactggctgggtcattattacagaggctgcagatttttttcccctataatattagctactgacagatggtgggaacaagtgaagacctgatggactgatgatcggttttatctggaaaatcctgtctttcctacagaaaaagagaccaagacacataacagccactgtgccatttttaaggctgaaacagacaaatcaaaaccatcttctccttcaagcatttaatggtatttccaatcccaaccagagcacaccaggaatgctttcccaagggcgtggccaggacctgggagagaaggtcatccccactcccctagtcccgccctggttctgggcaggaggtagcaggcccaatgcctcccagacagctctgtgttttagaagacaccagagaaggtgtctctaaaacccatacggaagcccacagtagcctcaaactggagcaccccctcctgtgtgtgttttcatgttaaagagttagggaaataaaagcaaatactggaaaactgcagtgtcttcctagggtcccttctgcctttcatttccatgttcaacagtgactgaaggcctttaaaaaacctctttggctgggcatggtggctcatgtctgtaaatcccagcactttgagaggccgaggtaggtggattgcttgaactcaggagtttgagaccaacctgggcaagagagtgagactccatctctacaaaaaatgcaaaaattagctgggtgtgatggcacatgcttgtagtcgtagctaacttgggaggctgaggtgggaggattacttgagcccaggcagttgaggctgcagtgagccatgactgcatcactgcactctagcctgggcaacagagtgagaccctgtctcaaaaacaaaacaaaacaaaactctttccatcaccacctcctttttacaactgcttctcccagatagcacttacttactagtgcctggcaaaatccagcctgctcatcactcaggcttcctgactaagtgcagagccctgaagtgcaagaattccagcagataaataccttctaaaggggaaagcttcctaggacagcttcagttaaggggatgataccccagtcccagaaaatttcccttcaatcaaagtggttttgctgaccacaaatgcaaattgatctcttaatataccttatacttagcatcttggtaaaggtgactgcacaattcccccatcggtggtgaaatctgctcctgaaggaggagagcatgccaactggcagccccatgggaatttgcaccaatcttatgaacaacctggaaattggttcgcgaaagcagcaccaggcagaagccaaaaatagaggtggcatcaccacaaagccagcattcaaccccgcaacctcactgtatgcactccccaaacgcatcacccaagaaaatgttctagctgtttaaaaaagaaaaaaaaaaaggtactattttcccaaataatgggggccaagtgacgtgtccacggcgggtattctacgaatcacttataagcttgaaggaaggggagtcaatcaatgattaagactagtccctctgttcctaactcttaacaggataatgcagattaattcaaaccttccccaaacctgacaaagcccccatagtgcctcagtgtgacagaaatttggaaattctcctaagaatcagggtatctgtacccgaggctctcacatgatcatgttacttaaataatacaccaatctgtgatccccgaagaatgaaattgttctttcctttttctttggagggtgggatgtttgagggtgggggtgaaataaagtgcgtttgcctgtcggcaggctcaagagctgagaaacattagctgtcatgaaccacaatcaaatcaggtttgaaatatttagcagtggcttggaaaatgcggcggtgcagctctgacaggcgagatgtgcacagacacccactttccattataatggaaatatcaggcctgttctgaatatgtataacccagaaaaatgtattgatttttcattcggcattaaaaaaaatgaaatagcctgcagctgtcaaaagccttttgttaaaagctcatctttcctggaatgaggtttaccagaaacaagttttaattgtatataggacctcttctttgaaaaacaaaataacctatctgcttactttgaagatagagttaaagcttttcctttctccattttcaacctaattaacccaaggacgaccactgaagcaggtgggaaaggcggggtacactctgaccatcaagactgacacggaggatggcagctacaagtggcgtttgctggtgtctctgtggtgggtggaaggaaggactcggggatgtgcctcgctctcgttcctctaactcctgtgtaggtgcggcatcctgagactcattgtataccctgaccaatcacttgtcttctttaagccttggctggcacaactggaaaacgagggcagaacactctagcgtgtccaatcctcttggcattttgttatcaatgggaaacctctactggctgcaaatattctacagaatatgcaggctttattttgcaaatacaggtcaaatcaaatcccacaatataaaagatgactactaaggcctagaccacttatttcaaataaaatccagtgcgttataattctgctacaatagaaacttttaacggaacacaatctgcaatgctggtggacgggcagttgtgttgctcccagcttgttacttctactcccgtcttctctctctaagccaggaaggaagaggctagtggtggtaatctttgtggctacaccgatggaggtgggccactccctatgccattctccctctgtgactttcgagcaagtggagtctcatcgaatagtgaccacaagtcctgccagtgactctccatgagccccaagctatatcctacctgtaccgtgacagccagacccagaatgtagcaacctactctgcaacatcccagacacatctcaaatatttactccctggttttattccatggtgttcttccagccctgacaacctggctagatgcccgagaggtaacttccaagcgattaggtcttctgggtaacaatgccctgcctcgggaattttcccttaaatcaaggtggtttttgcttaccacaaatacaaattgttctcatcacacatcgtacactcagcatcttagtaaaggtgactgcatgttctcatgtatgtacacggaaaagggaatttgccaatctccatggaagtcctctgtggataatcatctaaattaaaaaaaaaacaccaaccaactttgcccattccatcttctacttctcagcagagtatatacatttactgaggaaaacgccagatcacaagaggaagggcctgggatccaaaccagcactgatgagtgggacatattgagctaactaaccctatggtagtccaggcaggaaacctcgaaggggtgaagactgagtgcagatgtgtgtgggagggtgggggcaggagaaagcaggcaggggctctacagctggagcatctatttactcatcagaagtgtaatattttcccaccttctcaggatgtcatttcttttccaatgggcaaactccagcgcatgaataaagctcgagacattcatgcccatttgctctctgcgtgtatgataagcaaatgggcctcccgcactcctgcgggcctctagaagctgcctcttcagtaggaccgaagtgcaccaagtcaatgggacagagtgtgggaaaaacagaggcaggtctccctccaggggcgccattgccttcatccttttccattttctcacccacttaatctctctgccatgtgaaagacctctctccacctgctggactaaacagtcagaggtcagcctaatgctcctacaggtaattttcccaccctggtggcttaccaaaacaaagtggccaaactgctaacaaactgctagcttgttttaaacaaaactgccttctcaaagatgacaacgacacaaacagatttcagccctctaaaagtggagaagatggggtcagaaagaaactggggtcatggaaaactcagacatgcgccctggctccaatgatgattttttttttttttttttttttgagacggggtctttcttcgtcacccaggctggagtgcagtggtgcaatcatcacttactgtagcctcaaactcctgggctcaagcgatcctcctgagtagcttggactacaggcacatgccaccacgcctagataatttttgtatttttagtagggatggggtctcactatgttgcccaggctggtcttgaactcctggcctcaagtgatcctccttccttgacctcctgagtagcagaactacaggtgcactccaccatccccaaataattaaaaaaaaaaattctagagataggggtctcgctgtgttgcccaggctggtctcaaactccccagctcaagtgatcctcttgccttggcctctcaaagtgttgggattacagatgtgatccactatgcctggacctacaaactctttttcacatggatcctttaagtaatcattttaccacaagaattctttttaccactagatggtcatttaccaaatacacctggggccacagcgcctggagtttctggacagcttgaaaggtggtggagagctgccagcttccaagggggttgcagcagggaggccctgcaggaaaaccccacactgaaggaattcagcctccttaccgcccccaccctgaccccgttcctgtcccccattaccaccatccctgttttttggcatcaggctctaagaatcaacactctgaaagcaactctgggtattattaaaaatgactaattggagaatagagaccatttatgcttttgtatatttgaagatcttaccactgtttacagaaacaagaaaaatggggattgtgtggcaagaggcagcctgggaagggagggccaggctgcagctgcgtgttcggcccctgctgggcagagtatggcccagctcaacaagaatgcaagcctgggggagcctctccatttgcctttttactttacctcacctccaacttgagcattgacaggagagagcctgttacgagtccaaagtggccagggcctattaaggcctccccgagaaaatttcccctttcagccgtccctcctgtgggaacagcacagaacgccagagcatgaagtgaaaaatgctgccgttgtgtggtgagggacgggtcctgccatttttcctctcccaggcaaggccacttggccatttgaacaatttgtcaaaaccgcacaagaattacgggggtgggtgggggtcaagagaggagaaaaagggaggaaacgcctagagccagtattgcaacaagttccatttatctgtgttcttagcaaaagcacctgggttgccccctgcagaaatccagaaaggataaaagtaaatgtgcggtgacaaagcacaacggaacgaaatatgtcgcggactcgcctggtggctattcacaggaagattttttttttttttaataactgaaaggtgtgagttccagtttgtaaaatacaaacccaaccctgaaacgctctcggaatacacgctaagtaagaaagctagctatgtcccagaactctgaagtaaacggaattcagcagggattagttcccttggatttctacagagccatgattgttgctgttactttcacacatgaaatgtaaaaaaggcaaattccccgagcatgtctgtagcagagcgtgatgtgattgtgttgtcatttatgggaaataatcgcaggcccatctctcccttcccccccccattttccagtccaaataaccatgaaaaattacacttcaatgtcagcgcgacgacaaaggaggcgcgctctctgggagctcagcggatttgcaggggtttttcctttctttggacaaaaactaccttcaattgtacttcatttaaaacgtgatctaacaaatgcattttgacaagttcctttctctttttctcctttctttcaaacagtattttacacagtttaacctcacaccaaactggaatgttctagaaagaaggggcatgcaaaatagaaggtccttgataccaagaagggtgtcccccatctcgttaaaaacaaaggagtcaagaaaaatgattccaacccagtatgctactgagaaagagaggaggatgagagagaggaaacagtaatgtcttaaagacagaaaatttgataaagccccaccccccccaaaaaaaagctggagttgatagaagaaggtctcgatggagtatttatttgctcatcagaattaaccattttgtggattcagaggcatcatctagggtgtctagatttatggtcagaattgggggttcatgacaatgtgggggggatgaagaaggggagcttccctgatggggtacccgttccctcctgtccccttcctctgtaggaagggacatttttcaacagagcagacctgcctgaaagctttttaacattccaggtgtgaggctgagcagtccctacaagcatctgtctttcaataacaacctgccggaaataaacactgccaggtttccatgctgggaggggagaagacaagacagataaacacacatgagtgatagagagtaaattaaaaaatttaacagtttccattaaagaagactggtatctccttctgaatcaaaactgacttggcttgtcagagagagatcttatgcttaatgcaaaaaaaaaaaatccgtttccttatttatttatttttaattggaaaatactggaaatatatggatgaaaaaaagtcaaggagggcctgtaagtgtacttaagcatctatatacaaatgaaggtgtatgggaaatgaacaggatgtaccagaactgatattaaatgatggtgattagaacctaatgggcataagtgaaaccttgtgggatggctctcgtaacaggagcgtcaacggtgatggatgcaatctatacaagaacgacagccagggaaggagagatggaggggcggccatgcaggcccaaggcatttgcaatgctggggagacacagtttgacaataccaatgggaatgacggactatttggggcaaagagaagcaaaaaagcaaagagaaaaagaaagaggtaaacattttgtgtctgaccatcgaaacaaatggcacacaacagagaaaaataaaaccatgactccagaggtctgagtcacatgaggatacaaatgagggacttggattccctgtttgccaccttactctgaagcccacagcgtctgaagaatctctaacctattcagaaaacagcttcacccttgcgaagcacagaactcaggcagaaatatgagtttactcccaccagtggacagcagaatgaggaactgactgtcaatgagctttgttttgcatgatcataagccactaatatgcacagctggtaaaataagctgattcataaaaacaaagcacaaacaaaaggcttacactttccaaaccaaatctggggaacagaaatcaggccagcttgaggcaatgctgcacccagaaaaacaccagctaaatctgctctcccttggccagacccaagcatatacaaaggtcactacgtatttacaggttgcacattcaagaatgcaatgctagaaacgtgtgaacacccggagtggccaagaaaagacccttacaactgcaagcatcgtggggagccttcaggtgcctaccacgagttccctggtgccagcggagaagagcctaactctgccagaagccagacccaagacatttcaaggtgcgtctacacgtggaaagtcaaaaactgggctactctccaaaaaccatccagtccccaagcatgcatcagtttgaaacaaacaggcaacagaagcaacatgtttcagttgacatttcctgggaaactgcaaagaaagtgaagcaggaagctgaggtacagagaaaatccaaaggtttacgttcaagagctttcctccattaatgggggaaaaagcagatggaattgctaacttgtcatttttaataggcaccttgtacagctattctgtgtccaaggggagaaagaatattggatcctcctcctctttagaaacttagaaagtgatgccagtagttggatccaaagcctctgtttttttaaagtttggatcctgtacaatgaaacggtcttttgctagggtttaacaaaatgccacccccacatccctttcacaatgattttagctacagcagcgctcctcaaatctcccacagctactaaactgccctgtagactcagcctcaggactcgctgtgtatctatttagcttttcctcctgtgaggtgtttctcagacctaagaacaggctagcaacccttgaaaagcaatacattccattccacaaatgtatacagcaatatctctcaaggcccaaaaacacacagtgatagtcatcaagacaaacacttgaacaaaagtaatttaaattctagactcacaccccatcctgtttagtggtgggaatattcgaaaacaacaaatacatgaaacctaagagaaagaaaatgttgccatgagatgacaaagtcatcagggatcgggcagaaggtgcagtttagtgacaaagagttggtacttgacacagaaataagggatctatagaaatttgtagcacacaattacattttaaagaaataatctgggatgctgagatccttccgtgtacacactgcagttggcggaagcactagaaacccgctgacagaaaaatccttacttcagacgtccccaaactttcataagtgagcaacttgtttttttgttttttttttcttttttctttttttgagacaaggtcttgccctgttgcccaggctggagtgcagtggcaccatctcagctcactgcagccttagcctcctcggctcaggcaatcttcccgcctcagcctcccaaagtgttgggattagaagtgtgagccaccatgcccagccagcaacatttcacaaagtgaaatacagaaactggacagtgagagaataaggaaaggaaactcgaaacaaatgaaaggttatgcttcactttgtaaggccaagattttagcaaagaagggtaaaacaagccagaggtgtgaagatgaactaatcaaagggcagtgcaacactgaagataagaccgtcccatgattagaaagaataaagtaagtgattcttcacttaccaagcaaaatcttcaaataggaggaggtcggaggaaggagatttagatggcaaccaatgaaaactttcaaaaaacaaacccaggtaaggttatatcttaaaattaaatatatattatggtaggaaaaaaaccggatcaatttctgttaagaagagctagcctatgagttgactcaactactaaagaactttgctgaaaggttaaaaagaataggaaatgttccaggagaatggaaattaagacagaaaacagccttgaagacaggtaacttgaagaatggagatatataagcaagaaaagataaaagggacattggattaaaaatctacctgtgtaaaatttagctggatacaattaggatggcaaaagcagaaatttcttaggtgttttagaaaatataaaaaggataactaggcagaatagtccaaacacaaagagagcataaacatgaggacagcagatctgggaaggaggaatgaaggctgttcgcaaaagcctggtcaccggcaggttctacctgtgttttgaggtatttgggggagctgaccacaagtacctcaattttacagactaggagaccagggattggagcaggatagggctccaaagccacacagtggggccaggcacagtggctcacacctgtaatctcagcactttgggaggccaaggcaggcagatcatgaggtcaggagatcgagaccatcctggctaacacggtgaaaccccgtctctactaaaaaatacaaaaaattagccgggcgtggtggcgggcgcctgtagtcccagctacttgggaggctgaggcaggagaatggcgtgaacccgggagacggagcttgcagtgagccgagatcccgccactgcactccatccagcctgggcgacagagcgagactccgtctaaaaaaaaaaaaaaaaaaaaaaaaaagccacacagtgaggaaacctgaaggagggtgtctaaaggaggatgaaggccatcagctgtgtagggaagaagtgctcggggtgacgcttacacagtcaaacaagacagaagccatgggcagtgtgggcggtgcagcctcacaccctgctccctgggtgctggctctgcgggaatcttccctccatcaaggtggtgatgttgaggcaggtggattctaataatggtaccatagttgttcaaagcaatgcctaatttttctttacagtttaagacaaatggcatggcaaggataaaaaatgaactcaccaaaaccaaagcaaaccccacgatacacaaaacaaaaccagccaatcctgtttccaggcacctggtaccctgttaacttcctgcccagtggcaacatgaagccccaaataaaagcatcacatttaaagaaaggacaagacacagctctctctccccctctcctacatccgcacacactcacccactcactcacatactcctcccctccatgctcttttctggaaaggggggaatcccagaagtactgctcccaaatggcttggggcagagctcatcatcgatattctggatcagggtgaggtccaaggcactgctgacagggttgctgtcacagccccgaatcccagccacagagaactagcaaaagccaagtaattgctttttccccttccactaataagcttttcagcagaggaagaattcagcttcctgtagtcaacagacccttttttccctgcctctcctcgctccaaataatctaaagtgactgcaatttcagtcctggctctccagcattcagctccaatggctgaggtcagagggtgtcaagtgagggctctccatttcttttctactctgccttcacaccgcccatgtttctttgtaactgaggcaacctgcctccctcgcccaaccatcacatgcacccccagcacacagcacacagacctcacattccaggaaatgtattttaaggcccaaaacacactggggctcaggagtggtggtgggggggtgggtgtccctttgctgtaaacaactaataatgactgacctcagatgctctggtgaccagagcagctgatatccccgttcttagaaaatgcaccgcagcaggacattggcttagaggtcgttaaaccatgtggctggttgtgcggtttttggtttagttttatgcaaatgactctggttcctaaattcttaagatcttgctatgcatttgtggcattggtatcttcaggcctggctctgtgtcgaatgagaggcaagtagactgccccgaaaaccctgccccgccccctccccttcctcatttccgagatgaatgaaatgctatttcaattaagtcctgtagtaacagtgctccccttccctgccttcatagagagctaagccgagagcacagacagaactgaaggtgaacaaacaaagggaaatggaatgaatgagagaatgaacaggtgcatgaggggaacgagggaggccccggcaggttcctgctcctccgtgtggcggaaaagagggcaaggtgcggacaccagaggcttgcttctggaaaagcagctccaagcgggggaaacagaggcagcactgcggagatgaggcacacttcttcctccccctgcgcccagtgcttgtgaaggtctggaagggaaggaaagaaggggagatgcacctgagaaaacactggaaccccctccccctgccaccacacacacgcctagaggacgcacactcctggctgcagcccggcctgtgatgggaatttatttccctcaattatgtgctcttgtccccagtctcagttcatcagcacagtgcagccaagtcaatgaaaggctccataatgaagtcatcgcatgcacagggacatcccggcacctgcccgctgggctggcagggctgcagccacgcccggccctgaaccaggcctgcgtgggctctccgcccccaactcacatcactgccccacgccacgtgctcccacgctctgtgtcacggcacccccgtcctgccccaggagcctgtgttctggctgccatcttctttgccccaatcccaaatgttctgaccgcaaagcatctgtgacccagaccaatcagtacaaaacactgacgactttccctttctcctgcctgtgtagaccccttcaccaccaagagcctgatcacaaaaaccaataccacgcgcctggaaagcctccattggcttaagtcattagcaagtatctaacaatagcaacacaatcatcactcagctgaagtagatagtattaggactctcatttcacagatgaggctcagagaggttaaattactggtgaaggtcacatagctaggaggtgacagctgatgccaaggaccatatgcttaatggctacctctagaggcaccaaccatggtggccttcacaggagaacacacacttgtgcttgtgctgtctgtccatccatccgcccacccatcacatatccatgtggcacctaccccaggcattgacaacacggctgtgaacacaacaggaaagcccctgctctcatggggcaggggcaggaaggagtggggagagtaaaacacagtaagcagctcagtaagtgagcatattctaagtcagaggctgctaagggtcaacgataaagtagaaaaaggaatccagggagttccttaacatgggaagctcagagagggtggcatttgcacacagacctggaagaagtgagagtgtgagccacaggaggctcacatggcagaggcatggcacgtgcaaagacccagggcacagaaggagggctggcctgctggaagagcgctgagcgctaagcagggagagaagggacaaggcaggggataagctcagagaggtcttgggcagcatcctgtaggccttgctacccactgcaggccacgggcactgtgagcatgaaaggtacctttgagaaagtcagaacaaggtgctcctccagcacctcttcctctgggcacatatggtcctgagacccaccactccctctgctgggtaaggtagtgtctgggatggactgcagtctttatgcatcccccttagcagagaactgtttgtgtgggggacaacctgcacggctttagctggtggccccggcagggatttccagtagaaaaactcctgtctttccctaaacatgcatgtgcaatatatcagtgcagatacggatgtggctgcagatacagataaaatctctttgaacctttccatttactgggggctggcaggggtgggggtagagctggcctcacggtgaagaaacacaaagaggggaagcggaccagtggctatcctttgccatgggcggtgctgcagcacttggacagtctggacgcccataaaccaaaggacccatctgaccatcgtgctctgaagcctctccctgagaagaggacagggcagcaccaagactggggtgaaggactcaaggctcagaatggcaaatgcagaaattagttactgcggtgcaaatgcagaaattagttactgactgttctgcatgtcccttctatggaaatgcattgtccctgcacctaaatgtatttcagtggactttgtaaatttaaaagccatagaaaactatgtgacctcggcagggctattttaagctagcacttcctagtacaaaatgaatttggtattgaggatgaaggggggactttatttttctcaaattggctgttgtagaagaaagtctgctcaactcagcactacctaagacgtgtctccccctagtgacacgcagacctctctgctactggtgccaccaccctgcagtctcagggctggagcaaggcagctaggtgcaggcaggcagcattagttctgcaggctgcatctggccctgaacctaggaccagccatctcttggtaccctgggagctccaagaaactcagtggtcaggccccggagtgttccaggttttgctgcaatgttaagaagtgagcccggagcacccccagggcagctgatccacacacagcttccgcagccaagggaaaagaggggatggatggaggccaggataaagaaggggaggggtggcaggtaaagggaatctccccagaggagtgaattcctttccaggcttgctggggacccaacagggacaccccaaaaggcaaggcctaaagccagagcaaaaacaagcagacgcaaagcaggggagagtaagcgatgggcgaagacataaaagcccaaagatgagagctgaatggaacaggaagcaaaccagggccaaacccatcacggcttaaagcaaacgttaatgtaggttccacattgatctgaagcccgagggggaggaggctgggtgcagccaggctcctcccctcctccatctcattccattcacatcatcaggagaactgtgttttggggaaggggtcaggacaatgattggagcctgaacttagctgctgccttttacagtagcttcccagaataaactgccccaagacttcatccatcaccaaaaaaggcaactgtaaaaacacaggtcgccagccccttgcctcacaccagcacagtggccctccctccgctcctggggatgggggtgctgagggggaatggagggcaggcgctcaggcctggcactaattgctcttggggatgctgtgtggtgtgggggctgttccctgcgctaagcagttaggaacttcctaaatcattaacctttctcggagcgcattgtactgggaggtgctccctctgcagcctattcacgagccctattgatctgccgcacactcggtgccttcaaagttgtttatgatcaatatgcaaattgcccatggcattgatctagtattaattttcaattagggaatccacaaggggtctctgagggtcaatacctaacaatgcaaaggaaactccgctgtggagtatcaggcctgatgctgataaaagcttcctaagcctcctcctcaacagttccaggccctctgggctgtcaccttcactgtggctcatttggttccctcctaagtcagaccccttcggcggcctcccaggctgggtctgcggccatcaccctgtgccccccctcccaccccctatgccactggaacacctcctggcctgccagtgcctgcccctcttgcccgccctcctgatcagatgcccccagacatgcctcctcatctccccatgccacgcccagacccaggaccactctctcccccagctccccaaccacacataccttcttcctccctctttccctttccctcgtttctgcttagtcacggaacgtcaccttggcatgctgccacggctggagctggcgagctgcacggtccccagaaatctcaggcaggcaggcagagcgccgggctgccaggttatgcttggcaaacaacccactgatgtcatttcaaaaaaccaggggggaaggaaaaaggcacagcttcaaatcatctgtttctccttctttctttcgtctagcaaaatttttcttcctaatgaagcccgggggtgggggatgttaattactttaccactcactcatggttcccagaagaggccaacgcccgccctccaggagcacagggcagtgcgtgtgagccactgacggagagtgtccctggggacagtgtgcccagctgggactggaatgacccgggaactcagtcattccatttacgcccctaacagcccctgagagacttgcgtgggaaagctctgcagccagaggagctgcaagagaaaaacgtggcttggtctcctcccagcaggtagggggacaaaagcagggctcagccatactccagcctggggcccagccggctcagcctgacttctctctctgccaggaggttgaaatgtgcttacgtttggaataaacctgcctgaagatgaggccacgatcctgccaagatggtgcccacgatcctgcctaagtcccaacccatgccctgcccactttccacactgccactcatggcactaaccagtgcattagctagccaggctaataggtttatggataacattaattaccacgttcctcattaatggatgaaatctttattggtgccattgatcagcggacttgttagctggcctcctaaccaatggcggatgtaacaagcgttcttattggcatatcaattaatgcaatcaattcctggccaacggctgccattcacttccctggttgttcgagagtaggagacagagccctgtcaagagtgcctttacttagagctccagctctcagctgacttccaggtgggctctctgccacttggagttcacctaccaaaaaaaaaaaaaaaaaaaaaaaaaaaaaaaaaaaaaaaaaaaaaaattcacacctacccttccatctgaaaatcacctttccgtgttccagtgatgacaaaagtgctaagctacgtcaggggacataagctgaaagaaaaggtgggaacggtcgggggactgtcagagcaaacaagaggattagagaaatcagatgtttctaggttaggcactgatagaaatgattcaggccccagactggactagggacaacactccagatgggaccagcctgaaaacacaagccacagccatcatcagccctctgcccaccctggggaagccttcctgaccccagcctccccaagccacagtcacacctactgtcacacctacaaagtcacacccaccagtgtctacctcacttagcacttcagaccacaggtcccacatggaaacatcacctgcccatcttcactcctacgcttcagtacggaaaaggacttaccacaggacgaacgaccatcccactgtcactaccaagtgtgcagtaaatctgtgcacacaagtgctattttcatgtgtgttgaaatacacatagtcaatcatttcaacagcacttatatcactgtagagtcgaagttggggaaaaaatttctctgggcagcgagaagtttttagggacattgattagaggaggctcaaggaactggggatatagggtgggtccacagaaccatggaccatggtagagctggactactgatgaccagtgatcaccagggcattaacaccagagcaaagaggccgggctcgccaggcccacagctttgggaggaaacgtggaggatgcctccccctaagatgtgctttgggctcaaaggattgactggagtttgccccagatgggagcagcttgaaatattattccagatttgtttctaaaagcctaaaattaaaaaaaataataaatcaaaaaaggaagaaaaatcactactcaatgatgctagagctattaataaactctgcaagcaggaacatttgactcaaggggagggggtgcaagcaacgaaaactggtgggaagcagatggggttggggggagaaagtagctttgggccaagtggtgacagggcccaggagcctgactgaggctgcggtgcagggacataattctcagcgtctgaaagcatggctcggggtttctaggataaacagcagaaatatttcctttcacttataaatagaaagtgccatttttttccacatggaacgtcatcacttccatgttcacagtacggaggagaggagagtcctgagcagacagggcagggaccagagagagatgccccagccagatgttacactctcagggtggggaccaacagataccaggaagaagagggacaagaggcctccaaggggaggccaagacctctgcaatccacgaagtgactttacatgaaacaggattgcacattctatgcaaaggtcacccaatgtgggtgacagggagataccccgacaaggggctcttcatcagccactcaacaccacggcgagtcttccagagagagtactcttgggttcttgcaacggcaaaagtcccagtgtacttctgactagagttcctacagtattaatataatggtgtctaaattcctctctggggagctcccaaataccacaagggttctgcacattttgattccaatttcacttttttttttttaagatggagtctcactctgtcgcccaggctggactgcagtggtgcaagctctgctcactgcaacctccgcctcccgggttcaagagattctcctgcctcagcctcccgagtagctgggattacaggcccctaccaccacggctaatttttgtatttttaatagagacggggtttcaccatgttggccaggctggtctcaaactcctgaccccaagtgatctgcccaccccagcctcccaaagtgctgagattacaggtgtgagccaccgcacctggcctcaatttcatttaaaatgctgtaataataaggcatgctcaaatgtgatatatgccaaaatttaacacactggcggccaggtgaactagttacgtggccaagttaaacagcttttgcgtagactttagcataaaacttctgccattttcacttaatggaagactcttctgggattgcaaggcaggctattaaaaccagtcctgtttggaactacttctgtatgaaagaggattatacagaaattgtctaaaacaaaatatagaaacaaaacagaagcttagttgatactatttaactaccttccacaattcttaattttgatctgttgatcaactctgttttgttctaattttttaacttaataagtaaatgttaaaaatctgaactcctaaaataactatagttttcaagccttttgaaacattgtttatatactaggtccaaattcgtttgcattttttttctaaaagagggctccgctaataaaattttacaaaccaccgctctatctgatgtctatttctagattaaaagtggagcgcactcctcagagagcctcccttgagaaacagcacagataactgaaactttccaggaagaatttaagaacttcacatctcttaagtggacaaaacactctcacatacatttgactggctattactactacacaggcacaaaaaagataatgtcccaaaatggagacagctgtgcaacaatggatgatttaaaagtattgcttaagttgtatattttcttttaagtaaaaaatgagggaagagaaagatctcttgatgactcctcatagaagcaaaaccaagttccttttataaaaagtttcctttttttaaaaaaagagggagaggggctacttctgttctctgtaatgttgaatgctcaagagtggcagttgataacctaaccagacagaacgctccccatggtagttttctcctccaaagaaaagagcttagaagctttctctttggaacagaagagtcctctattcctttatttgctcactaagtcattagttaaactatccgttcatgcctcctaggtttcagccattctggatccaactggacaagtgagtcacaagcctgccctcatggaacttaccctccagtagatccactttaggtaacataagatggctgtgttatgtccagagctttctcattgaaccatcacgtcaacatgtacttggacaagaaaatcacctctttgactctgtttgctcacctgagggatgacaaggttgaccctgggtggtctaacagggccaccatgctaaggctctaagttggacaccttcaatactatgaatagcaggaattgttaaagaattaaaccccacccactctaaaaagactgtctgatccaggcttccctgaatcttcacctgggtgattatgatcaaggttcttctaccaccaaacacaataagaaatcaaatcttatcagaattgagctataaatctgtgaagactccaataatttctagccaagggaataacaccacaaaagtactttttaaactaattactcagattctgaagtgctgccctaatgagccttctttctgcccagaacttactaagaggaaaaactaccttctggtgcagtaattactgctttccccttcaaacttctaactggagatcgatgctgcattttaagacccattgatttacaattagcctggctttcctgctaaagtgttttttaagcagagtttacttttattttattttgaaatctctgagatctggttcttggattttacattctcatgagaggagactggaaatctcaaaagaggaaggtaggcattggaagagagggcagtagaaggatgcaaatcagattcaggagggcggggaaggaagaaaaggaagttggtttggtcacagaattttttttttaaaagccaaaactcatgctgaaagggagagaatgaagaaatccaaagagaggaagcagaaggctgagcggcaggaggagagagctaggtgcacagactaataaagtgtagctgctgtcaaggtggctggaatagctctttatggcctccgctgtttattagcatccttgagaaggaaaaaaaaaaaagaaaagaaaagaaaagaaaaagctttgtgcatctttgcaaaacaaagcactagttaaaaatagtgtatgcagcagggacagtgtgctaacatgagggtcctggcagctccagcatttgcacaatctgtcccatgaggagagcagaagtaagcgaagcaattaagaatttcatgctgattgctctaagcatgttttctatgccataaagatactagcataaaggatatggccttgcttctctccctcccctgcctgctaacttttgccttctagcttttggacttttccttttctttgcctcccatgtttgaggattcgagacagtggttagccggcctggcaccactttatggaatctgtcacttctataccgaaagaaatggcggttgtgtgcgagtctctccctgcccttgatcaagagcaaatctggaagaggagatataagccaagctgcattactaaagccctaaagagggaaggcttaaagaatggggaaactccctctgaggcctacaaatccgggctctccaaggcccctcctgccactcccattctggctcttcactatttctgggtcccaagaacgactggcagaagatggtcctggacaaatgagagcaaaaagtaaaaattcccaaacaataaggggggagggacaaaccacaaactttttgcttttttaaaaaatgtattttatagcaagattggataggccaatttcaaagactaatatgaaaaaagtgcaattaaatccttgaaaaactgacagatcagcaaaacaaaaccacccggaggagagcccgattgagcctcattaagagggagttcagcctgtttttaaaacccttcttaacacttagctgggtacctcccagcagtgcgcactcccaatgcggctggcataattagtgtcaaaatggaaagaaaaaaaaaatcaacctaggaaatagaaattaaaacacaaattggtgggtggggggggggtgtcaaatggaaaaaacattccaaattcaaacaacaaactcctatcagtccatctgagggcaatggggagatagcaaaatactctactgtacgcagagataaatacgttccaattaaacagagagagggctggggcagattgagaagatttatgctgcaattccccatcttcaacctctccctcttctcccaaaatatattctacattgtggtcacgtcaactccacaaggctggggttaatggcagatggatggcaaattgcaccaacctcatcaattataaccatcatgcctgacaatggggaaaatgagatctggtgacaaatttccacaccttcagccatcaggatcccccaacgctggagcgcgtgcacgcgtgtgaaacagtgtgtgtgtgagagcatgagtgaatgcattacatatgaaaccaccagcctgtaataaggagatatggagctgagacccattatagaagggcaggccactaaggaagaaatactctggagatggaaaagatggcaggcagatgaagccattttattaaatcaggcaaattctaattcattctgcagagacagaggaacgaaaacggattcattctcagtatatcctctgagccagctcttatcacctcagcagagggaggagtgaaagaaaggttccaagattcatctggaaatcgagagaaaccttcccctttaaaaagcaaacattaaaatatatctatttcaataccctgcaccaggaatatggaaaataatgctcgcgccagagaaacgcaggggtccttctctggctttccaattattccagcacgtgaagaagcttacaaatttgactcattgcaataggaaatcagaaaggcaactgcagcctagataagttgttgacaaggactgacaaaagggattgtggaacatctcccccaatggcaagaaacgccaactgccaccttccccgtggtgggaacttaaatgtcgattttctagttgaaaacagtggaaaagaaaggccgtgtatgagaacaccaagcacagaggttgcctttcattaacaaaaggcgcttgtgtttagactgcaattagaaaaccaaggttttaattaaacaattacataaaagttagtttggctccctgtatagtccaacacttcaccagcgccttggggttagtttagcaatgagtgtttagagctctggctgctatgaaggggggaaagaaactgatgacacagcgtgcatgtaactgtaaagctaggcgctgtacctgtctgtctgcagctcccctgccatgttctagaacaaaggaaaagccaatgagactgacaatgagcacgcacgtggtcagaccacaagccatcagtaacatcgtactactcatggctgaacagaagagattattcaaagtgtcatgcaagacctggggggctcacgaggcttccggtgttcccaagtgaagagctgcgtctctatcaaagcacaggccaggtgcagctagcttactctgtgcctcttttaactaagagggatacgcaggagcttagatgccttcaaaatcccaaaccacctctgggaggagaagaaagcaatctactttttcacctgctgcttttacaccacctggagacagctgcccagggcagacagaggtacgtgtaggtccaagggcttagattcctaggggagacttcaatgtctaatcttcctagcacatggaaaactcctctgtggctcccagcaatcatcaacctcaatgctcaagagctgcaaaatgaagtgaaattagttcttccctatacacatcagctttgaagacagaaggtggccaccttctactaaaccatgttgcaggaacagcctgggccatctccacccttggtgaaatggattgtgtcaagtgagtggggcctggcttataaatacagacaggaagattgatcagttttcactccacagcacccaccaaaagtacacagacctcaaaaagcaaggccattctgccagtagggcagccagtaaggagaactccacactgacacccgcaggtgatgcttcagatcacacctccacaggagctaaatgcagccttatgtttccacaattccacattcccctgccttcccacctgcttggaattcttccagctctgaaaagacccatgtcaaatgataaagaatccaagatgggcagccagttgatactgaccaatggcctcatacattgcctagcactggactatcttcctaggcatttctgatcaagtcactgaaagaaaacctaaacaacagagctaattggttggcaagatgctgtattctgtataatacccaaggctaaccaaatcacaaggtaatcagtatttgttagttttcatagaggaccagccccatttgggtttcacaaggacaggaagttcctccacctacagagataacagaaaaataaaaaataaagactaagctgagtgtggtggctcatgcctataatcccagccctttgggaggctgaggcaggaggatcacttgagcccaggagtttgcccagcctgtgcaacatagcgagacttcatctctacaaaaaataaaagtattagccaggtatggtggcacatgtctgtagtcccagctactatgaaggctgagatgggaggatagcttgagcctaggagtatgaggctgtagtgaaccgcgatcgtgccactgcactccagcctgggtgacagagcaagatcctgtctctgtaattgacaaaaacaaaacaaaacaaaacactaacaaaacaaacttaattccaagttaacaaaagctgaggagttattttttcccaacttcaggctgcagccctgctaggtttgcaaagaaatgggaaatttaaggataactctgaaggttgtataattcatgccactggttctaaaaagcaaagttgccttccccaccaaaatccttcatctttcagacaaaggcagggttttcttgccgtttccaacacctgacagtgtgaactaccggagtaagagagcaaggaccagggcccgctgctcctcagcctgaaaggcggggcagccaatcagaactaatctctgtgctggaagtaaattcagtgttctcttccctgatctggtgcggcggggggctctgacggcaggggtgggcttgcttcccttggtgcccccatcccataccctaaaaactaacaagggcctttctggtcaacacctctcaccacaagcagccgtggaagaaattattttagatcaagcccaaaatgaaatccaaagcaacgaggctgactttatgacttatttatttatttcttccttcacgaacagaaggttaatataagagcaactccttggcaaacctttaagggtaattcaagcgacactgatgtgaatcaatgttccctttgtgaacacattacttggcagaaactggctttttgtaacccccttaaacatagccggcaaaacaaaaagaggggggaaaatgtccttcaaacaaaaggatgaggtgaaaataaagagagagtcgactgcactttattctctttcatagaagcaaatggatctggtgcttttatacattaatcaatcaatatcactggctgtacatcagcagggtagccaagttatgaatgacctttctggcaaagaggacacttttaatgctcataagactgctcatagcttagcaactttccgaatttatgcctgcatgattaccccttggaggcgagcagccgtgagtgctgcactaaatatggcaaggttagtcgttttcaatttgtgcagagggaggaagagatgtggacctggctgccccatttacgcacgagctgccgcaacctgggcgacacagagggcagagccccaggccctgcagcgggtcagggctggcctcccttctggaaagccggccgggtctcctgctcagcttcaggccaaaccaaacacggcagcttcagacagctcatctagaaagctgtgcccagctcaacttcgctttctgtctgcttctcacaatcagatcctgagttcctcaagctgacagccaggccggactggccagcacggggtattcccaggctccctccacaccctctgccctctggcttctgtgcctctgaaagccctccccacgttgattggactcctccaaccaggtcacagcttgatgtttccaaaaagcaatgagaactttcatctttgttttttctttttttaaagcaatccacagaagggcatttctaccgaaaagatgacgctctccagaaacaggcagcccacataaacaaactgttgggccaatcctctttcttttcccctgtcaccaactcagccattctcttcatgtccaaaaggcgagaaagttctctggattccattctttgtgggtggaaatggggcaaagggttgcctgtgggtctggatttctatgacaaccgctatcgtcccagagaggccgcaagggggcaagagacaaaatcccacctcagccttcttctcccaactcctcttttacagccatgtttaaagtctctggaagtctggaagagattcccaacttggacatgtggaagtccacttataaggccccacttttttctgtctcccatagagggaaataaagacgtttagggatttgaaatatagctttaacttcatataaattagaacagaagaaaccacaggctaaaactcattggccccactggagtacaaggaaaattcagcgcagaaacgagctttactgagaccatcctttagtctacaaggagttgcccagtgaggggagaatgcggcaggacatgggttagaggaaatgaacagctgggttgtggtcacttctggtaatggccttaagaacacaattgggccactccgtgttcatatttctgagatcagaagagtttacagaaacaggactccgctccaaggtatcactgatagaagcccccaggccgtaagacaggctagtttacagaaatggaagataaataacaatgaaaacaaggagaagagaagcttgtaaggacactatgcaggcatctccgaaggggtggcgagttcttatttccgtgcccctcgacatggtggacgtttgcagctcctagcccagctgggaagtacaacactccctcagcgttccacatacttaaataaataatcctggtctcgttaccgattatattttaacagatccagattcccatctagaaaaacggctttctgtttagagcagggaggaaaacacagagccccctccagctggtccccctgcagagctggttctgggatggtgccgcagacacccgcttcctgttccatcaggcctcggtggaacggctctgttttcccccaggaagctccaaatccacaaagtcaacaattcttaaaagcctgcccgctttcccccctctttcctttcagcgtttaacaaatatcaaacgtgtgtccctccaaaccaccttccaaatttacaaactttttactttttgagacagagtctcactcactctgttgcccaggctggaatgcagtggcacgatctcagctcactgcaacctctccctcctgggttcaagtgattctcctgcctcagcctcccgaggagctgggactacaggcatgcaccaccacgcctggctaattttctatttttagtagagatagggtttcaccatgttggtcaggctggtcttgaactcctgaccttaagtgatccacccgtctcagcttcctaaagtgctgggattacaggtgtcagctaccacgcccagccaaaatttacaaacttttaggtcccctttggagctgccaccctatggaccgccctcacagaacacaacacctcagggaaggggttggctaaatgctcagtcgtctgtcctttctcgatctttgcgcaagcctggctgttcctctgacagctctcaaaaattcatccctggtctgacagttaaaaataatgcatttattttttgtgtgcacaacggtgactttacagcctcccagggttttcccaagttacagacaccacttgccaccacttttcttcatcttctcttacctggccaacagcaacgggtcagcagatgcttttctcacgcaccttccctctcccatgcaaatgactccctaacccgccatccacctggcagacacctgtgtcccctgtgctgtgttgacatcacccttctggaagtgcttggtaccaactgtcccctacagccactgggctgtcttgtcacacattgccatatggcatgtcctcgttttgcatatttaaatcgctatatcaagaatattaacaaagataaaagggtatgagatcttcccactaagcatcgggtggaaattctcacattagtaataatgcaatgtgaacccaacccccaggatggagaagccactcagaagctggccggccatcctgttttgggtgcagtcccagacacaaggacaagccctccctgggaggcgggttactcctcagagtctggaaaaagagactgtttccccatccacgtgcacatttcattacaccagtgaatcctgatacctgggtaatttcaagcttttaccagagcaagagaacaccctaatacccccaaggaagccccaaacgcctcctggaaaaccagagtccaggaatggaaaaatacatcagagaaaaattctatctgaaaatgtggaattaccaacatgcaaaagatgccagaaccagaaagcctaacctgaaggtccacatattttgtaaaatttgcacaagaatagatagaacccgctgggcatggtggctcatgcctgtaatcccagcactttgggaggcagaggcgggcgggtcacttaaggtcaggagttcaagaccagtctggccaacaaggtgaaatcccacctctactaaaaatacaaaaattagccgggtgtggtggcatgagcttgtaatcccaactactagggaggctgaggcacgagaattgcttgaacccgggaggcagaggctgcaatgagtcaagatcatgccactgcactctagcctgggcaacagagcaggactccatctcaaaataaaaagaatagatagaactggaattttctgtttcattgtcggtgtcctctgctccctgagaccatatgctctgtggggaggaactgtgtgacacactgtataccatgcaacttcaagggaaatcaatcatgttaggccactgctgaatacctccaagggtttcccatagcactgaaaccccaaacttaggaccctgcttacaaaggtgggtctggtggtagatgccacccacctcagccctccctaggacaccaattgcactggcctaccttctgccccagggcctttgcaccaaccaggccctaagcctgctgtgttccctgccttcttcaaggtcaagtcaggtcacagcctaaatgttaccaccttaaagatttagcatttaacctgcctttgcagtattcagggtaaacaaatatttaatgaggaaagctttcccttgataaggagtagcccagctaataagtgaagaaataatagaatgagaatatcatcattttgccagctccaaataaataggagatttgggcaatgatcatcaatggctaataacatcacaaaacaatcagtgagacatgtatctcctgatcagatacactgactaacacacatgaagcagccatggagaaaaagtaaaactgctcctaaatgagatcaagtgtctagatttaactatcagttcacagaaaacacaggggtacagaagaacatgttcaacaatgctgtggggctataatcatcaaaacatccaaatcccgactgcagggatcctacaagatacatgattcagtttcttcaaccaaaattgcaaggaaggaaaaaaaaaagttagaagaggaacatacaggtaaagagactttagagacatatcaattcatgtaatgtgaacaccatgttggcatctggatttaaacaaagcaactatcaaaaaacacatgtattaggctgggtatgacagctcacacctgtaattccagcactttgggaggccaaggtggaggatcgcttgagcccaggagtttgagaccagcctgggcaacaaagcaagaacctgcctctacaaaaatgaaaattaaaataaataaaaataatccatgtattagggaatttttaatatgaactcaatatttgatgattccatgaatttataatttttaggggtctgatattgcagtcttgttaataaaaaaagagagatacaggtcaggcatggtggctcacacctgtaatcccagtgctttgggaggtcggagtgggaggattgcttgagctcaggaattcaagaccaacttggacaacacggcaaaatctcatctctactaaaaaaaaaaaaaaaaaaaaaaaaaaatttagccaggcatgatggtgcgtgcctgtagtcccagctactcaggagactgaggcaggaggatggcttgagcctggaagatcaaggctgtaaagagctatgatcgcgctactgcactccaacttgggtgacagagacagagagagagagagacagagacagagacagacagagagagagagagagaaagaaatagggatgaaatgatataaccaagatttgtttgaaaataattgagtaaacggaagcagggagtgaggggtagtgtatagatgaaacaggactggctgtgagtgggtatctgccgaggatggatgatgggttcatggggtctgctggttcatactctacttgtggatatgtttgaaattatccaactcaggaacacagatgatgggttcatggggtctgctggttcatgctctacttgtggatatgtttgaaattatccaactcaggaacacagaaggttcatttttttaaaaaagttccttccttctgcactttgggaggccgaggtgggtggatcatgaggtcacgagatcgagaccatcctggctaacatggtgaaaccccgtctctactaaaaatacaaaaaaattagctgggcgtggtggtgggtgcctgtagtcccagctacttgggaggctgaggcaggagaatggcgtgaacccgggaggcagagcttgcagtgagccgagacagtgccacttgcagtccggcctgggcgaaagagcaagactccatctcgaaaaaaaaaaatttccttccctgactatccctctacaacaggtacctcaacaacccctagtcacccatcttatgtttgattttaattctttacctgacccttatatttttttcttttgatttactcctcataaacccttcttgatgtaagctgcacaagagctggggcctggccacccacattgaccaccatgtctctagggctttgaagatacctggcacatgggaagcttcattaaatacacattagaaaacatagaagcacatgtacaaacaagaccacatcaatcattcagtagcaactcagagcgtcgtgctctcttgtctttgtaggaagtcttgagggggcgttcatcccccttcttaggaagatgtgaaagtattcccgggccacccaaacagtttaagcattgtatcttggcaacagactgtcatgtatcgatagacacacaagtaaagctttgaaatctttctctaaacttgtgaatgaagcaccaaataccatggacagagcagcagttgacctctcaggtggcccacactcttgggcctcactgcatggccacccatgttatcgatcagttgatcacatactggcacatcaggaccaccaattccaatcccaacagctatggcctatatcagaatccaaccaagaatgaaagccatcaatcatctacatagcaggctatttggaaacatccagatgttagagttttgaagatgatgcctagcgcaatctaatggaagtgttgttcaatttatgagccgtgatgatgccacctgaaaaatgagactgtcctgtaatcctggaggatgcaaataaagatgtgggccagtgcatttccagccaggatagcccaaatgggtgttaggtgaggccaatattcctctaccaatgaggctattttaaaaagtggattttgcattcctgcctactgtcaggatagtgacagccggctgaaccaccctaatgaattattttaaacagaagatgaaacattaacttaggaacctgagagagaggctttcactttcttaagatgaacctgtgacttgaaagagtctcaccaacaagtatttatggatgacttccatgtgcccaggcagggcacaagactgaggactcagttgagaaccaggtaaggtcagaaagggaagagaccaatgggaaaagggcttgtggctgagatccctccaaggtgccatccactagcccagcagaaccctcaatatacacacaagcccgttcagccccgagttgggctctgagtgccatggatctgtcttcaccttcatggcggccctgtgctgggccatatcaggcatttgggctgtgacagcccttgttaacagtagtgcttggctcgctctctggtgagctcccagaatgaacttggatcttgtccccacccaatgtgccaacccaagggcacactgacaaggagtatgctgtcataggctatagggacaggtataggcaacagaaagagaaggcgagtttttgctactgagatggagggtacctccactacctgtgactggccaaagaggaaggctgtgggttggaggtggtcagggtcacctccaaactcatcacaaatgagggcttccaccatcaggactggctcttcccaattctgctgctgaccaaggcttctgtatccacagagaagccctctgtggggctgtgtgccctgcaggctgaggtcatggttacgccactcatgctcctttgaggcatgaactctggagtagggctccccttgccctacacaatggaggaaacgccatgctgaagattccacatgccaccgggacagccctaagtgggaaagggagacccggggcttctctgagctcaacatactcctcccacacaaaggaagcgggtgtactgaggctgcagcccagaaagataatgtgatgcggtcgtgagatgcccaaattggaaggaggaaaaaaaggaacaaagaaatcactgtggacagatgaaatgaaaatctggcagggctctgtcctaacaaatgatcctaaaatgaaataacactaacttttctcctttggcagatacacagagagggagagtgagagcagtagccagagagggagggtcagaaagaaggttgcacccactatgtgccaggctccacactaagtataatgacactttatgtacattccctcacttaactgtcaaacaaagattaatgaggtagaccccctgagggtgcatttgcgtccccttttataggtaaaagaattgaggctcaagaagggtgcaattgggagcccctgaaacaaacatgtagacatttttttgtgcatgtgcattcatgagcattcttctggggtgagggatcatttctttcattagattacctgaaaaggtaagaaatcctcaggttatataacttgaccaaggtcactaagctcagaaaagctgggatctaaactcctatgtgacttataaaagcttctgcaaccagatctgatctgaaagcccccagtcttcactgagtaagaaagaaaaagaaatacaagagttgaggagatggaaaaggaaatgagatgggtgctgggtctaagtagaatgtccaaggacatttacaagcccctttcactatcccagaggttcttcaaagccatggcacctctttgaacatcttcagtgtacagaagtgacatgaaccaaccccacaacaaccccacccattcaccatccacacaggcacaaacccaccgacctgcagttccaccttaactgaagccagagaatgacctggaaacaatgggataagcaggaaatatccagattccctaaattatcatctctctggaagttctgcaaaatatgaacagtcattatcttgcctgtattgcttttcttaatttggagagggaactgtgtagaaagtaattaagagtgcacctcattggcatgaatgtttcccaccatgggctgaacagaagatgatgtggtgggtccagtgtcaagtctcactaagccagcatgagactgtccaggcggcatcctcaaccccacaggaagctgaggaagctgtcatctgtgactctgctgggaagaagctcagcattaattctactccaccaggtgtcaataatgtcagtgtggcatattatgtgattactctgagtggttacacaaaatttagaagaaaaaactgcactaacagcatcactcgcagagcagaactctggaaacgtgcactttacgcaatggagaagtgcactctgtctaatcctgagcaggaagatgagaacgattttataagtgtgtccccttctatctggaagattgcaagacacatggaacgcctttcagaagacaaaacataccaaaacataccaaaatctaagactgtaagaagcaacatcgtaatcccatgctaacgttaataccctcatggagtacgactacccatgagcaaactcttcttccatttattgttgacaccagtttaaacatgtaatccacatttattttgattggatcatctatttttgctcttgcagtcatttcctgtcaagtttctagccaaggtgaaaagtagcgaacccccagagtagactctttgacaggggaaaaaaaaaaaaagaagaagaagaagggatgctgtctgtgcccaggcactattttcttaaggtggcagctttcctcttctaatgatgcctctggtcactgcaccaaccagttgagtcggtttttctggaaagttctcaccaatcactgaaaagggtgtttgtggaggccaaaaatggtgacaatatcaagagccgcacagagtctgccaaggaacccacggggctccgacaagatggcgcccaaggaagcatggaactaactgagccactgacgaatgggatagattctggacaaaagtaatgtaagacatgatccctgccccaagatgtttccaattttagggatgaatagtaagcaaatactaagtaatcagccaaacgaggctgtccaatctttttggaataacatgagatacataagtaatacataaatgtaattgggtgcaagggtcagtggtacagattcactgctatattcatttacaaaagtggggaatgagggaggtatgtgtggttttgatgataacatcattttcaccctcccttcttacccattcctgcccttcatcttattctctcccacttggagaatcagcgcctatccaaggcccaagctcacatcctcagatcatccttacctgctctcttccccatttctcccaggtggaaccacctaaaaacagcattaagtgtctcactctaacctagaccctctggcatcctgcaccttacataagctttccctcacattcttccatcttccactggggagccagtcttaccctctaaaacaaggagagatcaggtgactttgccaggtcccccagatctcagggctccgcactccctagaggggaaagtccttgcttctccccctccacccgttcgcgctctatctttggctacaactacatcccatgacctttatacactggcagatcttcagttttcagggtccacatcgacaggcttcttaggaatcttctcctgttagacagtgagattcctcaggcacagagagcctcctggtcaccttctgcacctccaccttgattgcttctccaggctcaaggctcagtagccctctgttcacctcaggagttgtaagaaacaaccctattgtacatacagccttggagatgaaagcaggaataattacctccagaaaggaagagtgggtcttggcaggaattctaagaatggacaggagaaaaagctgacgatgatttgacatgaaaggaagaaaaatcagaaggctgtatttccaaaatccaaataacagagaaagggtgaaaggtgaagatgagactatgctttctgagccatcccagggcaaacatctgctttctcattcatttccttcagataagggagagaagacggaaaggaaggcaggaaggacttcaaatttttaacagttttagtagagaaaatggaaaattaatcaaatgctattaccaggccttacatttaaaaaatactggggagactagaaacacgaaacagcaagcctggccctggagccttcactttcccttctgtgagctcttgcacagttaccagcccctctgccatcatccttcaaggaccagccagccagagccctcgccaaccagaggctcagttatagcagaacacactgatgagagctaaaggtgttttttttttcttaaataaaagatttagaaataagttacaatttatcataataccaactttcacattctaagaccctgttacccaggctctgtccaaggtaacacatgatcttccttcttattctgtaatagtttctttgtccacttcccaaagcctccattcctcgtttgacaccatgagtgatcagtgacattttagaaaattcttcccagtctttctaaagttctggcctgctgaatttcctgatcatctagaaaaccgggaaggggagtataggctaaaaataaaccttaatgaccaccactttcatttgccaaatatttctccctattgatttttattagccattttttcaaaacaatctcatttaaacagttcaattccttattaaatcatctccaagcatatcctcactagattctcattaattacaaagggaaaaatagtaacttcagaatggataaccccagaaggaaccaccataactaactgaccaaagctgatgcccgcaatcaagagacaaatcaatatcatgtatctcatgaaacaatacacgagaaagaacacgctttcttttttggcatttctaccaaaatacacagcctgattctaatcataaggaagcatcacatgaacccagttgaaggatacttgacaaaacagctgacctacactcttcaaatatgtcaaggtcataaaagggcaagacagaggaacaatgctagattaaagaatatgggccaggtgagatgtaatcccagcactttgggaggccaaagcgggcagattgcttgagcccaggagttcaaggccagcctgggcaatgtggtgagacatcatctctacaaaaaatacaaaaactagccagatgtggtgatgcatgcctgtagtcccaggtactcaggaggctgaggtgggaggatcacttgagcccaggaggtggaggttgcagtgagccaagatctcgccattgcactccagcctgggtgacagagctacagagctagaccctgtctttaaaaaaaaagaaaaaagaaaaaaaaacggctgggcacggtggctcacgcctgtaatcccagcactttgggaggcagaggcagacagatcacggggtcaggagatcgagaccatcctggctaacacagtaaaaccctgcctctactaaaaatacaaaaaattagccgggagtggtggcagtggtggcaggcgcccttagtcccagctacttgggaggctgaggcaggagaatggcatgaacccaggaggcggagcttgcagtgagccgagatcgcaccactgcactccagcctgggcgacagagcaagactctgtctcaaaaaaaaaaaaaaaaaaagaaagaacatgaaagaggacagctaaatataccttgtgatctaagatattcttttcatacaaaggatattattaggaaaatttgaataaggactataataacctaatagttttatagcaatgttagttctctgattttgatcattgttctgtggttatgtaaaatatctttgttcttaggaaatacacactaacttattttgatgtcaaggggcaccatgtgtgaaatttactctgaaatccttcccaaaaaaatggcaatgtgtatatttctatttattctccgtctttatggagagagtaagattatgaatgcgagagagaagtcaaaaaaggaaatgtggtaaaatgctaatatttggggaatgcaggtgagagaattttcttactatgtaaagtacattacttttctataagtctgaaattatatcaacattttatttatttatttatttttgagatggagttttgctcttgacgcccaggttggagtgcaatggcgcaatcttggctcactgcaacctctgcctgccaggttcaagcgattctcctgcctctgcctcccaagtagctaggatcacaggtgcctgccaccatgcccggctaattttttttttttttttttgagacggagtctcactctgttgccaggctggagtgcaatggtgcaatcttggctcactgcaacctctgactcactggttcaagcaattttcctgcctcagcctcccaagtagctgggattacaagcacgcgccaccacgcccagctaattttcatatttttagtagagacggggtttcaccacgttggccagaatggtcttgatctcctgaccttatgatccgcctgcctcagcctcccaaagtgctggaattacaggtgtgagccaccacacctggcctttttaaaaatatttttagtagagacggggtttcaccatgttggccagggtggttttgaactcctgacctcatgtgatccgcccgcctcagcctcccaaagtgctaggattacaggtgtgaaccaccaagcctggccaaaattttaaaaattttttaaggaattggctgggcgcggtggctcacgcctgtaatcccaacactttgggaggctgaggcaggcagatcacgaggtcacgagatgaagaccacactggctaacacagtgaaaccgtgtctctactaaaaatacagaaaattagccaggcgtgctggtgggcgcctgtagtcccagctactggggaggctgaggcaggagaatggcatgaacccgggagtcggagcttgcagttagccgagatcctgccaccgcacttgcactccagcctgggcaacagagtgagactctgtctccaaaaacaaaaaacaaaaaaaaaatttcaaggaattacaaattgaaattaaaataagattcctaacatccccagtccaattatataattttgtattcttaagtattgcaattatatatattatgcatatttcagatgatatgcaaatttcatttactacttattgtttccatattgaggaaaatgttcaatgaaaacagagctcctatcagcacttgcagttcccctccaatacaaatagccccaaaatcaacatattattcccctctttaaggctttctttttactcagaattcaacatgtgaaagtactctctaggttctcaatttgtttaggagattacgagaaaaataggagttttcaggtatttgtgttttgctttttttgagacagagtctcactgtgtcatccaggctggagcacagtggggtgatcttggctcactgcaacctccgtctcccgggttcaagcaattctcatgcctcagcctccggagtacctgagactacaggcacgcgccaccatgtctggctaattttttgtatttttagtagagaaggggtttcactatgttggccaggctcgtctcaaactcctgacctcaagtgatccacccgcctcggcctcacaaagtgctcagattagaggcatgggccacgtgcctggccatgtatttgttttaaataaatctatgatattcacactcacctacacgcctttcaaaagatggtggggggtgggggatgggcaaaactagacttccgaaagatggaagaaaatgggattgcaatttttggccctgcccaagatcctctctttaggcagaatggcctgctcattggctcccgaccagagtcctgaactcccacaacagcctggggtcttcttcctctgtctctactgatttatctttccagtttcagcctgactctctccttagagcttccccaccattcagtccaggaattcctcaccctcgaaggcccagagtatttacttcctgttccactctctgctactcactacggatcatcttgaaccctgttaaccttcaatgggcgtatttttcacatccttccaaaagatcataggctgggctcatttcttctgttctttttatattccctcacagcaaccagtatttacaactaacagatgtttaataaacagctgcaaagctcaacatgccctaatgttttcaatgcaagaatgaaggggaaagaatgcctctgaatgactccaaaagcatgcttggagaaaatggcaaatgtttctgctgcacatttagaggccccagaatacaaatttgcatttgcacgacttcccttttcaatgagaattcaggtacgttctttcattttatcttattagtatgatgagatttgttcttgatgaatccgtaccacctcagctactcgtcatcattccattatcactacgtgtttatagattttcccttttattactcattttattttttccatcaagtatagttcatatacgaggtagtaattaccaggttttctgctccttacacttcaagttcgccaatttttttctgatcataaaagcctaagtgcctattgtcaaaaatcttgaaaacagagaaagtatgaagacgaaaattgtccataatcagtgctgtcttcatatagatattttaaaggaaactgtgacaattatatgtgtttttgggtcttgctacccacccctcagtctacggagcttgcttccatatccttaaatattaatcaagaacattattcttaatggctacacagatttccaccacataatcgtaacacagtttacttaatcttcttatattttaaaaggcgtatggctgatgtttctaattgccttcgtaataagcatacttccttgctaacagaacactcactttattcaaagcacaataccctcagccaaaacctgttgtctgttgtgcccgaggacagtcatatgatgcagtcccagccaatgagatgtaagataaagcaagtgggcggggctttggaggaaacttttaaacaggtggtctttcgtgacgcatgcactctcaccagcctcactttcttgtgcctggagctcagatggaggattttttgattttttttttttttttttttttttttttgagacagtctcactctgtcgctcagcctggagtgcagtggcacaatctcggctcgctgcaaactccgcctcccgggttcacgccattctcctgcctcagcctcccgagtggctgggactacaggcacccgccaccacaccaggctaattttttgtatttttagtggagacggggtttcacggtgttagtcaggatgcgatctcctgacctcgtgatctgcccgcctcggcctcccaaagtgctgagattgtaggcgtgagccaccgcgcctggcctggaggagccatctttagaccatgaggaggcaacaagcgcttggtgagaatggctacatggaaacatagaaggaaagtggatgtctgctgactcagtggaaccttcacttctgcacctgactgccctcctcccaaggctgcttatataaggaaaaatgaaacctctttttttttttgagacagggtctcgctgtgttgcccagggtagactcaaacttctgggctcccagtatcctcctgccacggcctcccaaagtgctggcattgccggcgtaagccaccacaccatgccctcctaactcattaaagccactttggagtgtttctgtgatctatagctgagtggtgtgaaacaaaagaataacctttttttcccccaccttctgctgtcttcatagcctgtgatacagcttcaaaaacaaggaccaagacctacacaccacaactgctggggtcatccagtccaacctgggacagaagtcctggacaggagaggtgtcaggtctctcttcctctgaaagggggctgcctaacctgttgatgctgtgctcccatcaagaagctcacagagaatgatatgggccagtgtttgttccgttttagtgctcatacaactctagctgagattaaccaagaaaactgccccttactggctcagggaactcccatagagaattcccatagggaactcccatagggaattccaaacttacaggccagtaaggtggcctggccgctcttccacctggaacacagctcactgaatacggcagatacctgcagactgggggcagaaactgggctctggatccctttcccagcggggagacctggcttggttgtgagcccagccctgcagggaggctgcagatccaacacagctcctcttggaagccctctgtgccaggaggcacagcccagatgccccgggaatccctgagggaaatttcataaaacatgtgactatctacacagcctgctagaggccagatcattgctcacacggctaagttgaagcctcagtgcagtttctacttcattcagggaactggagttgcagctttcactagaagagctgcttctccttgatgaacaaaccattccgcccataaaaatgctgtggaaagtactgtaaacgctaatgcagccaaaaacttaaagactggtatagggttaactgaactgccacgttaagtcaggtgtaacgagatgacaatgctttaatcctgctgcttaaagcgatgtctaaaatgtgcaagtcaaatttcaagcctttgtaagaacataatggtaaagataatttcatcattatcaggtgatgcaacaacctgcccggtcccagggctggaattccaaacagtcacgcctttgcagagttttacagccctggaagagaggggaggccacagtgaacacctgtgatgataactccagcccatgccccggtgatttttgacaattgaattaatgttgaaatgagcttatttttctgtcctaaagggaaaacgagcctaaaatcctgttaatctagcatcctggttactcagtttcaccataatttataggatagtttttctatccaaaaactaaggctatttttatcccaacttcgccgcttcataaaacacacgtgcatgcatgcaacttcagaggttttggcctaaagcaagttttcaaaataaccgggttcaaatatttcattgagatggtaggggtggaagaatcttatagaagcaaattttactgttctctgtaaattcagacttcttcagccacagatggctcagggatccagtctcgcttgagaaacatgatggaataagcccacagtcagagcttcttctcattcagtttcatgaaagctctgagctcccacaagtgtctgctggaactggacaggaagcttgcaagatgctggctacgattcagcgcagtcaccgccttccccagtcggcccaccatccccagccatccaaccacttcctccccacgaggcatcgcccgttggaaagttttattaaccaaatgcttgagggtttctgtatatttatattacctcctcttctctcctgttctacccaggcatgttgaaaaaaaaaaaagttatgatatactttaataaaaacaaaattaaaatgattaaacctttcatatcctttagagataatctctcttctcctggctggtccaatctggaagaaaacaaatgtgaaccatagcttgctgctgcttttcaatttttttcccccctaaagaaacaaacagaaaaagccgcctgtggccagatttttaaaataaattaaatttgtcctcacacacggcagccaggtgtggttgaaacattctttccagatatctatgatatatgccaacatccttccctctgggggtctttcaacgtgagcctgacaatcccaaggggaacagagacttggcgggggagaaaggggggtgattccaaaatagttattgaaaaagaatcactatttcccaattagccctgtaataatgccttacaggaatgactggatgccctgcccctgcacgccatctaccaaaaccaaaaaatagtctacattcctgattaaagcaaagctcagagaaaacagcccggtatggcacaaatctccccggtcttatgtgttctgaggaagtcttcagatccgcccagggtctgggcacaggtccgcagggaatcaaatggctgcagaattcgatcaggcctgtctgtccaaggccagctagatatggaaatcagaagtaggtcatcagccctcaagaatcggataatgacctctggactcgcagcgctggggccaccaagagaacaaaggtgttaaggcactgtgtaggtttttctgttgttgttgttggtgttgttgttacaatatctaatagtgagatcaaattcttattgtggaaataaacatcacggtcttctgtatgaagatggtctgcggaaagtgaccacgcatcagagtgtccagcgtaggaggagaatctcagtttgccttagtcatcatagcacacaccctgagcacagtaagtttctcattcttcgtgtctggtgtttatgttgtagtagagacgactcgtcctcaagttaaaaggacaaaagtctttcctgtgtttcatacttgggcggtgagtcactaggaaaggatttggtttttagaaaaaaaacttctgatccctgggctaaaacagagagccccaaagagctatgttgatcccagacaagcacgtgcgtggattcttcaaagttcaggtcaactcaggcccctcctccttgcagtcagccctgtactcaaggttgctggagacatggcgcctctatttcctgcccaaagaagcccccttaactgggggccacgggttgagtggtgaaggaggcaactcacacctgaattatagtgggcttgtaaacctgaacagggcaagtcacaactttgggaggctgaggcaggaggatcacttgaggccaggagttcaagaacagccctgacaacatagtgagaccctgtctacaaatgaaaaaactagccaggtgtggtggtgcatgcctgtgctacttggaagactgaggcaggaggatcacttgagcccaggagatggaggctacagtgagccatgattgtgccactgcactccagcctgtgtaaagaccctgtctctacaaaaaaagaaaacaaaaacaaaaacaaaaaaacaaaaaaaactcacctaccaaaagtccagctgacatctactacaaaattcccattattgccataaaaacatgtgggctgggttcaaggctgcatagcagatggccaggctacatcctcatcacacacgcacttcactggtgccagtgccggtgacaggctagaagccactccagtgaggacccctgccagggccaatcagatcagggctgccctccccatgctgtggggcttctcaatgcttctgaaatggactcacacaaggaagtcacaaagggctttggacattaggaaaaccatgcaaactgtttccacttctcagagcaacccgaggcacgcgctctggagtgtgcagagtcacagataactgctgctgctttgctcaccgcagtcttaggatttcttcatttctatcctggagagaatccagcaatggatcacactgttatctagacacaaagaatcccacccctggggcaaagtgctacttgtcccgtggatgagtttgtcagcctgcagcaaggaggccagacgcagtgggaagagcacagccctgggccctgggcctctgtaccaagtccctactctgctgctgtctacagcagccctgtcctcaggaaccttctccagggaaggaaatggcttctgtctgcacatccaatacagcagccactagccacatggcactgagacagatgggccgctgcaatgggaacctagcgacatgagacatccaagattgccaggaagggtccgagttcgcctctgctttatgctcgtgcaggacaggaacggccctgtggaggctgccctcgaggctcacatcacaggctcaatctgggaaagaccagccatgggaagcaggatgtgacttgccctggaagcgcaagtgaaggacgggctccgaatgaaagctacacaaggtaacaatatacacactgggatctttatattatgtccagcctggagtatataacacagggtaaggaaaaaccaaggaattaaaagtccttcaggtacttcgagcaactgaaatcctttggatggaagtccagtcaatcagctggccccctattgaattctataccctaatgggtcatagaaaattgtaaggctctaggtagcatctaccccaaccagagcacaaacaccacacacaagcccagggagatctgcttagtccctaaaagcacagtgggcagcaaggaggggtttctatttcttttttttcttttgagacggagtctcgctctgtcgcccaggttgaagtgcaatggcgcggcctctgctcattgcaacctctgcctcccaggtgcaagtgattctcctgcctcagcctcccgagaagctgggatcacaggcacccgccaccatacctgcctaatttttatatttttagtagaggtggggtttcatcatgttggccaggctggtctccaatacctgagctctagtgatccgcccgcctcggcctcccaaagtgctggattacaggtgtgagccaccatgcccagctaaggagtttttatttctataaatccctccaacaggagcctaacacaggccagcctgctggagcaccttcagcaaaggcagcttttctcgatgctaagaccatcaaatttcacaggcacaagaaccttcctccacgtggccggctgtcagtcctcttggtgtttgccagcaagaaggtttcggtgagggctgtgtgagaacaggcaaggaaagagtcatggtaaaatgggctcagaggacacagggctctgaccccttttcctgtcctaacaagtgtctttgagcacttccggcttcatttggagtccccttccagcgaggtcgcagtagttaatcccatgccaaggccagcactgagaaccgtgtgctgcgagcaggaaaccagagaaggcctggtgggcgctgacagttctgtccgaggcgacttccaggatctccatgacctcccttcatctctcccaccaccttctgtcctaccctcctgccccacccaaagtgaccacagaaaaggaaacaagaaactggcttcagatatcagaaagtctgggtaatagactgaactgtggtcctcccagtgtcctaggttgaagtcccaacctccagtacctgaggatgtagctatgactggagacaggacttttaaggaggtgattaggttaacgtgaggcctttagggtagaccctaatccaatctatctggtatgtcctaatcatacagagacacaccagggggactcacagagaccaggctatatgagaccaaggcctcgggagaagccaaaactgccggcacctggatcttgaacctttagcgtccagaactgtgagaaaatacacttcttttgtttcagccaaccaatggaaacggggggtgaaaaatacacacattcttttttgactttataatatgacaatttttgataaaattttgggttgaaacaacagatggccctgtaccaggaaaatcacacattgtctgatttttgatattctaattagagcagaggtcaaagatcttttaaaagcaataaatggctccttttattaacatatacacaaaaggtctcaagatagtcttgaggcataaaactataaaaacccatttaacatccactctgaaaaacacatctttacaaagtcctttcaaagtccctcaaaactgctaatggaataagacataagtagcaaaaagcaaaattaaatgcttatttgaagactgttctcccaaactgagaaaaactgtgaaacagagagaaagatcagcaagaaaagatgtaccctatccaggctggcgggaaccacacttctctaaaatgcaagccaaaaaatattaaggaaaatgtagccccaaacctagcctgggtctaccagaagtctgaggaaacccagtgaggaggagctgagcatggtccaacagaaccttctgaactgctctagaaatctgtattgtctaagttaaccatgagccccatggcactattaagcacttgaaatctggttaatatgatgcagaaactggatttaaaattttatttagcattaacagagaattttgagaagcttccttgtggctctcaggagaccagaaagcccaggaaccagggaggtatgggcagcacttagactgaggccacaaaactttccactgctcgtcaatgtttgaaaaaaataatttggaaccataattcttataattgggtcacagtttgaagggggttccttaacatctgtgactctgagaaaaagcctttgagctatttctgtacgcagagagatagatgcatgttctatttcctccctggcccctaccaaggtcgggaacaagtttcatataggatgtaagtagccctagaaatggattctttggacattcctaaagacggtacaggtacaaatcattatttctcgagaaacatccattcaggcagtggagaaagtgtgaactccagaggctaggataggggatccatatgggaggggtctgcacacatggcaggagacagcagaggacggctgccacttcctgctacactgtcggctttaggaggtctctcccctccagtgaaatccagggacagcacccccaaatccagggacagcacccccaactcccagcccagcacaaacacccactgactggctagctatccatattcactttagggtggagtttcagattttcaagtttcttggatacacctttcgaaggtgacttgggatgtttcgaaataaaggtttcacagaaagaacacttggtatgacatgatgtcctgtggctcccttgggggtccccatgtcactgggctctgatgagccaacgggggtctctggcatactcacacccctaaaaagaggacccccgcccaatgctcacccctcaacaaatgcaaacacacccatatactgtctctcctaattccaggaaccatcagcaggtacccctttttcctttttttttttttttttttgctgtgccaaaaaaaaccctctctgcagtgagtggccacagtatcaatgcttctcccagtgggcagcgttgggcacgtgctgccacccactcatgaagatagcatggaagacagcctggagcccttgaccaagaacaacactaaccagaagggcagtgtacagctggtgccacgtgtcatatgctgaaacaacacgcacaaaaccctggtagcttcatcatcccagaaaaataacgcaacgaatgaatggtggatctagaacatcaaagaatgagtgaatacgaatcactgcaactcaggccactgcggccaggtctagataactgctgaaaaggtgcaagtcctggaacagccagccaggacacaggaggctgggtacgaggctgcacgctcaacccactgcccacctgaccatcctggtgatgccacaccttctccagggggaccttccagggcagcagcgtctgacagcagtgaaacagcactgcatatgtccaccttccagcagaccagatcattagcatattttgcagagagcaagcagaaaagtttaattgcccttaattactcagttcaacaaggctcctagataatggctctcagatttcttgcctggtatcgacgtaatttccctgactctggcttcattatatccctaacttagaagcaatagcgtctccaagatggctttccagaacagacactgaagtgccagtgaggctgggcagtcgctacaaaggtttcttctatgaggagtcagatttttggccttcacaccactctggggtgtgtgtgtgtgtgtgtgtgtgtgtgtgtgtgtgtgtgtgtgtgtgtgtgtgtgtgtgtgtgtgtgtgtgtgtgtagcgggtagtggggaggacacactagcatatacttaggatggactaagacaaggaatatgtaatcagaagccatcacaattacaaatgtaaatgaacaggcaattggcactgacctttgcagattgttagaggactaattaaggcaaatcaagaactctgttccaacagaaaaacaagacagtatacaccctgagaactactcctatcctctctatgtaaatgcaaaatgcaggagaatcacagagtaatcaaactacgaatattggcaaataaaaaacatctccatgaacaaaagacaaccaagatttacttcttcgtagcctgttagtgattctgctaaaatctctatcaacaagcaccaccaccattctgagcccttgccacacatctgacattctgttagagtccatataaatacatcccaccgccaaaacagccagagacaccagtcactaactccttgcttgaatattttaaaagctgtaagaaaaatacttacaaaaaggaatcaacctatgttatcctgtaaactccatttttcatttaacaacattatgttctcttttcatgttcatacataatgacctctctttacccttgcattgtaaagcatctttctaaaaagcttgctgaaatttacaatccctgtccaaacagtccttcatcagggaatgtcctttagacagataaagtcatgttttccccatgcctccatcaatgcttaaaatttcagtcacccccatttgttttgatgcacttttacatttaacttctctagttaaaaatactttaagttcctataccttccccaaacccggtaaacaagacatacagtaaaaaggaaaggagaaagagcgtgggtgtgctgattttataaaaacaatatttcagaaattcagagctggccacaacatattttagtgctatcagaaaaattacactgaaattgcatataatttagctatttacaaaaaaaaaaaaagatgtactttatatttagagggcagccttacaccaactttgcaaaataaaaacaaaatcaagtgagaaagctgaagacagtatatattcttggtctcttaactcttaagctgtatacattaagcacaacaccctgaaacttggtttaaaaagtgattcatcaaatgaggccagtgagtgttgcagtaaaggctgtcaccaaaaccacattatcacttggcaagctgtgtgcacctctctggccccagaaattcgctactatgaatgccaaagacgtatctgtaaagggaggatactgctttttgctccaagcaaaacaagtctcttaaattctgaatgatcgtgcaccctctgtaaactgagtccgggtccaattatttccaatgcctgagctggtctagtcatcagtgtgtccatattgagagtgcagaggagatcagtgatcagctatgttctccaactcataaaaagccttatatataataggtcgtcaataaagaattgttgaactttaattacatgcatgtaaaatttggaggtctatgtctacatgaaagaaaaagtacttaggacaaggcgagtaagagagaaaacaggaggaggagaaggagaaaggccgacagcagaaacacaaagggcctgtgttctcaaagcccagggcacttgatagaatgaagttaactacagtttcacccaggagccagaaatgccttttaaataagcaaacagggaagctgatcctacacatgacccacctctgagagctctccatttttcaagagcttctggtaaaccagggaagcaaatggcagatgccagcaactcagagctctggcccagtgcattggccagtgatgacgagtggtttctacctgtgggtgggtaagtatgaaatgccgagacgaaatcccaaccaattccagagactacttggtcttgcagaaaaaacactcaagccaataaaaataaattgtggggattggaagaggaacctcacctggttagttactgtctttgagagatgtatttccaagccatttttaaaacaggaaggcccagcaggcttgtgtgcttgtgtctattgtggggtaggggtggaaaagtgtaacgacaaagaccatcacactgaaccaaagacaatttaccacaggactcggcctgcccactgacataagggcagagctccgccatggcagggccacatgggcacagaagcctaactattagcacacagctggcggccaaggctctgtccactggtgcagggcaggacttagatgtacgtgcccaaccacgaggcctctcaaggagttacgtagccagtcatggcagatatagatcctggctgctaccagaagattctgaagggatggaggagacctttgcaatttcttctacctcgactccttcctccagacccacaggttcacatgggttggcaggctacatgatgaactggaccgactggcaaacaagtgacttaagtaacaggtaaactgggaataggtattttttgtcatccacagggcagaaactattgcagaatcatccacagggcagaaactattgcagagttcacccctcctgccttaggaggagacatctagatacctgtaggaggtgacatgagactggggatgaggtccagaactcagaaaggacaaggggttatttctgaagggttttgtgtaatattctgtggcatgtggacaacagaggagaagaggaaaggagaaggaatgtcatcacttagcaggatgatgacagaaagccagaacttccaactctagacagcacagccatggatggggagcttctggtcagagtgggtggggctcctaaaaggtgcaccaagacttcctaatgctcctgatgccacaggatgacatttctagctgaaaaatcatgtcctgacccttatgttaaagaggacagagttgggaatagtctataaagtcgatgtttacaaaatttgaagttgatcatcttaaacatctcaattctaccaggtccataatgtccgttctcttgaagatatcctttcaagttttgaagagccaacccctggggagagggaagatacatcttaagatgagttttcttaaagtggttcctaaaacggaaccaagttcttgttaatgtcaatatgaataaataatacgtaatactttgtcccttttgtcatcagttatatggaccgaactggagcctgtgtgtgggaggggaggagtatggtgtagggagggagtaggggagagagcaaaaacatgactccaggtcaaagccaatcccaaagcatcttgacatacggaagggaagtctatcatctccactgaagttgctcacacacttctcgggggaaaaacccctagtatgcactaaatgagaggaacctcgaaggcactggtgccgggctgcatccacggaagcactacattccaaaacagggaactgtttgttccaggtcaccgactctgggtgaaatggcagctgtacactgtttagtgtggggcacctcattaatacaaaaggaattctgagcagagtaaaagaaagaattgaagggtgaaatggaccagcttttaacagatgattaaaacaatgatgtatgcagagctggccaaaaaaacaccccaaacaaagcacaaaccctgagcaagaaacaggtctaggtgtgttggtagaaagaaggagaatccggggaatgactcaacagtgcactaatgcagagcagcggatcaaacagaggccacaatccctgggtggggcacaggctcccctacagccagatggcccaggggcctcagcctcaggcccatcctcgtcccttactcctgagagtgctcccatgtagacggatgggatcagaggcaaagcagaagctccaccaattaaggtgtttcaactttaaccagaagaggcatttgaaaaacacatggaagggacagtcttgcagtgaccttcaagtgacaaaaattatcccggtacccaacagccctttcctgaacaaacaatttctactgactgtcgaaacctcaaccactctagcaaggagaaaaattcttgaattgtggtctatcccatcatttgggaattgctgtttcatttatatgaggaggcagcgaaggagcagtcagatgatccagagaggagcaggtgggcagagggctttggaggggcttaggagggacgcctccaggaggaaatgaagctgacagaaaaactgatagagcagagcgttcagagattaggaaatgtctacttctggcagagtaaggttcgccatgaattaatcataggtacctagaaaaccagagaaaacaataagttgtacaagaaggtaaatgaaattataaaactctacatggctcagctgcgattaatatttatagttataataatgaaaacactgaatattaatataacccccaattattatttaatcataatggaaggtggagggaggaaggactgagtgtggagggagctggggagtgggagggagtccaactgttgtgtggggggtgcaggagtgtgcggggcagtgcctgtgtatttgtgggtagagtgagggtgcgtgtgggatgcatgtcagtgtgtgtggggtgtgtgggggtacagtgtctatgtgtttatgatgcttgcatgtggggggtgcagtgtatgtgggggaggtgcacgcagatggggcgtgtgggtgtagtatatggcttgtgtgggtgtgtgagtgtatacagggggtgtgtgtgtgtacaacgtatgtgggtatggtgtcttgtctgtgggctgtgtatgtgagcgtggatggaatgtgtaggatgcagagaaagtgtatgtgtgtgcgcgcacgtgcgagaacgtgtatgaggtatcgggctggtgtgtgtgccgtctgcgtgagtctgtggttggggtatgggtgtaggtgtgtacacgggtgggtttgtggaacagcacactggtgaaattctcatctgcccaggtagaaagccaagaggtaacatctaaaacttaaaaacaagaaacagtcgtagaagtatgagaagaaacatggaaataagtaacaaaagaaatatctgaaagttgaaagctgatcccctggaaaagggggtgggagagggccatgctcttctccataaagtttatgtaactttttgcctttaaaaaatataaaaatgtgtaatttgattatattaaggttaaaactgcacacatccatgatggctgaatggctgagaaggcactgcaggagactgtaggatcaggagtggccttgggtctctggcttggccaggccgttagacaagctgccattaagaagaaaaagaagtgtggcagagaaagtggtgagccaggtgcccaagaggtgggaccaatgagatgtccacgaagctcagcatctgggaggtgggaccagtggtgtccaggaagctgtacaaaggcatttggcagcaccaggacacaaaagctcaagaggctgggagccgaggaccaggccacagtgccctgtgcccagggacatggggcaggctgagaaccaccagccagagtcaggcttgcagaactatcaagggaagtcagaggacaagagaaaaacaccccggaagccaagggaaggcaagggaaggggaagggagcttcaagaaagggctgggcaacaatttcaaacattgcagaaagaaaacagtcaggcccagcaggtcctgggctgtgtcaatcaaagatcagcagcgccctcccaagagtggcttggtgacagaggaaatgggttgtaggaggttgagacatggaatagaggtgagcagttcacagggttctctcaagaatctggaagattctgttgtagagacagtgtggggcctaggatgaaaggagagcttttcttggaaagttttggtttctaaagaggtaagtgactgtcttgtgtgtctaagtggagagcaagagactggaaaattgaaaaaatagaaaagaggaggtgattctacccaatgaagtccctatggaaggcggagtcatgggtggagggagggagggaggtggggaaaaaggtggctgcagggagatgacatggggaggtagaaacgaggcaagctcccactagcaggtctcgacgcattgaagcagcaagcagcatggacccaagaaacacccagaatcactcccaaatacaactgaaatttttataacaagcacttattttattcctctctaaagttcagttttacagaccagactttgaggccacaaattgactactcttaatactgggcaggacacacgatgtagcatctgctttgtcaatttgaaccaataaattgaatctaaagtatgtactggaggaatcttagaatagaggagagtatcttctgttggcctgctccctgggtagtagcttgtgacttccctaagactgagccttgctccaagaaaagtgctgccaatttcctttaaaaaaaaaaaaaaaaaagaagaagaagaagaaagaaaagaaaagaaaaaaagacagaaaggcgggcaggcaacaatccctgcatgttccttccaaaacacaatgctcacctgtgaagtcagtaaggaacatgaggaccagctggatcagtaacgtctccctcaaacagaagtcctctggaggtctcaaggaggtgaacacccaggcccaacctgggcctcccatgcctgtgagaccactcacctgggtccgtggaggggcacctgcggatggtgaagatctgccccaggtcctcgtcctcctctggaaggcccttctgcagccgctgcagctttcgcaggctctcgcttcgctggtgcttcatggagcgcacatgctggatgaggttgagcttggccttggtggagtagttgcacagaacgcagtggtagtagcagctctcaccttctacaccactctcatgctgctgcaggtgctgcaagtaacaaaagagaaagacatgccttgggtaagccactcgaagcggccactggcatcagcccacaccatcctggtcacagccagaggcatgcctccaggggacacatctccacagccaaacaggacagtctttgatatggtttggctgtgtccccgcccaaaatctcatcttgaattctaatctgaactgtaatccccacgtgttggggataggaccttgtgggaggtgattagaatatgggggtggttcccccatgctgttcttgtgatactgagttctcatgagatctgatagttttataaggggcttttccctacttcactcagcacttctccttcctgctgccatgtgaagaaagacatgcctgcttccctttctgccattattgtaagtttcctgaggcctccccacccctgcagaactgtgagtcaatttctttcctttgtaaattacccagtcctaggcagttcttagtagcagcacggtaatggactaatgaggtcttcaactgtgagattccttagagggtttttttttttttttcccccagagtacccagcacccttctctagcagttctttgaaaaaacacagcaagctgatacccattcctatctcccccaaatggccccagccatgtggcttttcagaatgttgataatcctgatcacatgggccctcccagtgcaacaccggctttcctggcacaaggttaaaggtttccccttttattctctaaagtgtcctgctcttgttagatcaggggttggcaaactatggcccacgggccaaattcaacccactgcctgtttttgtaaataaagttttattggaacacagccacgtccattgatttacatactgtctatggatgtttttgaaacatcagagttgaacagttatgacagagatggtatagtccacaaagtctagattattactatagaaatgtgctaaattatgacaggaaaagttaagccaacccctgcttcaggtaatagcctctggtcatcctgcctgtatggcaccctaggtcaggaacatggagccggagctggtatctggctttttcacaagacaactccagtgtttgtatttaaaaccacagtctactgggagaaccccaaattaggttttcacctagattaaaaaatgccagaaaaataaatttctccagactagttccctgtcaatatctcaaagtcccctggcttatcattggccaatatcattggtcagttggtgtatcagatggtcagatggtccaaattacgtcctctgttgtacttagtagacacagtattgatcccagagcatggcagcctaagagcctccaggaggcaggcacagacaggattcatgtctggggtatcagaacagaagaggtcatgatgcagacaggtggcagaccccaggcttctgtggctaggaagacttaaagacgacccaacaacaaaactcacaatgtttctgagtctcctgggaatgtaatgatagctatggaccctttttgactaacagagaatgaatgtgcacctggtgtagaaaggccatctccttcattccaatgattcactttaggggaagagggaattcttccactgggtacacatgaagcaagggaaacactccccaaaagcttaaatgactgacccaaggtaacccagttagttagggggagagagagatgtagaagctgaggcttgtctcctccagccatgtacccagcatccttttgaaggaggaaattcaggtcatgtgagtgctttatgtgctcctgtgattacgtgtccttccttttttctcctcaccacctgtccccaacccccagcccagtcagccaagcctggcccatggagccatggcaggcacacaacaaacgtctcagaactgcccacgttgcttgtctcctttctgacccacactgcttctgtctgatgtttatgccaggataatggtttctagtcctgcttggatgtctcatccttgtccagcttagaatgcaagacactgacaagctagaatggttagaatgccctgcactccacgcaatcctgaaaataccagagtggccctgtgagtgcttcctatcaagggacactgccctgacgctcacgtactgacatgcacacgtcctgtgttcactgatcacgtgtgaaaaatccagaagcatgtttgtactttgctggaagaagaaacataaatgcaccaactaagtgtcacagaaaactcatgggaggggggttgaagccctcaatgacataaactggctaaagtatcccacaggaaatcttgccaacttgtacgtaagaatgggatgagcttcacaggcaccaagaaagaacaatcccttctgcccccaaaatgggtgattcacacactcatatgcagcaccttggacaaagcaaaatttctacaaccagaaagtattggaagaaccagtgagtgcaatgttacctattagaaaaattacaactggtgataaaaagctacttttctggagataaatttgagctgctttttgtttactttttatttattggtttttttttttttttgagacagggtctcactctgttgcccatgctggagtgcaaaggcttaatcttggctcattgcaacctctgcctcctggattcaagcaattctcctgcctcagcctcttgagtagctgggactacaggcataagccaccacacctagctaatttttgtatttttagtagagacagggtttcaccatgttggccaggctggtctcgaactcctgacttcaagcgatccacccgcctcagtctcctaaagtagctgggattataggcgtgagccaccgcacctgacctctgagctgcttttaaaaaatgatttaacctcactgccttctctgtgatgaggttcctttcagaggatgttgggaggatgggatgcactgaggcagtgctttctggaggttacaatcctggggagaaggaaggcagaagtgaagggagaagatgagctagcccacgtcccttcccccaactactccccgaggcccctcagaactcagaagccagaaacaggaccaggatattccaggcagcaagagtttgtcctaaaaccgaggagctggaaacctgtaagggagccaagaactgctgtcttaggtcaccaggaccaaaagaatgatattcattaaagcttcaactaaaactgagtgaataaaagatggcagagacaataaccatgaaattcaaagaaatacgttccatcaagagattttggaggtagaataaactatgaaatcagaccaagaatcactaaagccttacctccaatccccccactacctccctatgaaacaggatttcctcacaataaggcactgaatttcaaacatcaaatttgaatatggatgtgtgagagttctattccaaatggctggagtcttcaatctctgagccacaagagaggaataacatggccagaagagttggatggaaatgcgatgtcaaatgtccaaatccatgggctcttgggtcataggaccgtataaaccctggattgaaataaacatcataccgggtactcacactttaaaaaatggatatgataaaagatattctaaaatccactccacactctagctcatgttggtaaactacaatctcttacactgccatgaattattctgtctgccactttgagagccattttagcaagaaactgggcatgcattacaaatagtggagaaaagaataagaggaaacaagaaaatgaagccacggctgctcccacctaacctggtccagtgaacacctagggttctctcctagaaaattcatgaaagattcattcaaaattccaagcttgctttgtattccaagtttattctccaaaacacttaaaaaaatccagaataggccggatgcagtggctcacacctgtaaacccaggactttgggaggctgaggtgggcacatcacctgaggtcaggagttcaaaaccagcctggccaacatgatgaaaccccgtctctataaaaatacaaaaattagccaggcataatggtgggtgcctgtagtcccagctacttgggaggctgaggcaggaaaatcgcttgaacctgggaggcagaggttgcagtgagccacaatagtgccactgcactccagcctgggcgacagagcaaaactctgtctcaaaaaaaaaaaaaaaaaatccagaataaactatatcttggttgccaggaaacagctgtgcataaacctaacatcccaacccaaacttctgcttgggtctactatgtctacctgcatgtgacaagtcctgctctccccagattttccaagtgtctcgttatttcttaagttgtccaactggaagtaaacagagacccaaagctagcagcaaggtcctgacctctgtgaccttctccacatcattcggccatttcctaggccctgagcggctcaacccgcgaccctgttggtcagatcctctctcccttcctcccaagtggcactggcctcatccccagaatcccacccttggaacctgcctaataaaaagcagtggtagggagtgtgctaagaggcccatgagcactccacggggccagtcagtcagccaagaacatgccttccccgcagaagggagtggatgttttcatttggaggaggagggagaataatttgttcctgacccagctaattagaataccctcaattgggatcacaatgtatttaattaaattcactgtaatatatgaagaatccaccaaggcacaaatcccagtggtgcactcaagaaaggagctgcctgctttcagagttcttgctctcctcgccaggcaggaaatttttctcccacgcaaatcctgaattccccaaccccttccgcctctatcacagagtcacccgctggggaggagggcaaccgggttctgtttttactttttccattttctttactctgtgctcacaattcctacctactctcctttgttgggtcaggagtgtaattttaaaaagaaaacaaaacaacagctccaactgtgggcagtgtgctgggatgcatgccaaccggggacccaaagaaaaccagctggtgagcccatttggcgggggtttgtttcggtttgagtctaagtgtctacaacacgagacactgcatgcacgcgcacacacatgtgagcacacacatgcacacacactatgcccaaccccagggacttaacctgcaggtgatgcaggcagtgtcagcagcaactctaagaaaataaggaagggtataatgagggcattccccctttggcttgaatactgttttgagaatatacttcccggaatactataaaacacaggggcctcctagctaactcaagaaaatccagtatctccccacaaattactaatgagaaagcgagaccaaccagtatcttgaggtcatcctagctaaccaaaaaagagtgagaactcaggtctacccaaactcacttggttgggccaacctctccctataaccttaaatctgactatacttttccttgatcactcccactccaactcacttgcttgtttagaaagcacctggaggccaggcgtggtggctcacgcctgtaatcccaacactgggaggccaaggaaggaggatcacttgagcttaggagttcaagagcagcctgggcaacatggtgagaccccgtctctataaaaagaaataaaaaattagccaagtgtggtggcacatgcctgtagtcttaactacttgggaggctgaggcaggaggatcacttgatcccaggaggtggaggctgaagggaggtatgatcacaccagcgtactccaccctggctcacagagtgagaccctgtctcagtaaatagattagacagactacatagataaacagataggtagattagactagatagatagatagatagacggatagataggtaaaaacagacagatagcacctgcaaaagactggatcataagaactgcaaaggtactgtagctttcacagaaagaaacatctatgcttggcaattgaatttactttctgaaatcttggagaagtatgatgaaggaaggaagtatctagtttgagtcataaatgggagcagaaaaagaacccaacgatctccaagtcctccaaatgctgtgcagcggataacagactgtcctcatctggattaactggaaatttggcacacgttcgggggtcaacagctacggctggaaacgaagccagggttcatacgagggctcactcacgtcagtcaaagagaccttttcttgcacctcttcctaatcctattagggctactcatgttttaaaatgttcatcccgtctcagtttcgctggaagggggacactccaatgcttctgacacgaaaacatctcacggcccccatctgtctctgtgccttcccttctaggtctggctcactgagaagaacacagcaaagccctccctgcaaccagaggcacctcggataaaggggctggcgcgtaacaccaagcacaaaaagcaaactaatcattttaaaagaagggagacaacagaggctccgctgtgcgactttgtgggattctaccccattagtatgttgtgcttgttcagcctcgtcaaacactgaaagtcaaagagacgaaaagagggctcttgttagaaaataatgcatcgtgaaaatcaaaaaaacgtgttcctgttacttgtttcccagggaaaactaaccaacttctgtcagagaacattgatttctataaatctggaggggccccagctccctcctcctccccaacgataggaaacttctaacatctggttcctcatgcatggaatgcaaaatattgatcaggttttgtcaaagcctgccctttaaagtagaaacagacaaagtacattctgacacacacacacaaacatgcacaattcacaaacaaagcttcctcaggagtaccacctgttactacagacacacccgtggccgccctctcggcacactgtgctgtgcacacaggcacacacggcaactccatttccagagcagcccctctgagccagggggctattccaggagatgcgaggtgcttcctgcccagcagaggagaaaccccatggtggaatgtcccagaaaacccctgagacacctgtcaggccaaaggcaggcaggagagcctgtctgtaactcttctcagtccattgaactggaggccccatgatggaagaagctgcccgttacagcacccctgtccagggaaagacagcaaccacagcacgcaacagcttcagcttctcgcttcagggagaggactatgtaatctcactaacaaacctggtgagagggatggggagaagatggggaccagtaagtctgctaattcctcaacttgataagatgaagtaggaagacatagcgggtgttcattcaccatcatatgcatgcagagcatttactgtgggtgcggcatctacacacatactttttttcttttttgtctgagaaagggtctcactctatcatccaggatggagtgcagtggtgcgatcatggcttactacagcctcaacctccccaggctgaggtgatcctcccacctcagcttcctgagtagctgggactataggtgcgtgccatcatgcctggctaatttttaaattttttgtagagacagagtctgaccaatttgcccaggctggtctcaaactcctgggctcaaagaatcctcccacttcagcctcccaaagtgctaggattatagatgtaagtcaccgcacccagcctacacacacttttaaattttcacattacaaccccatgaggtgggtcacatttggttttcatccttggaggagcccaaagctcaaagaagccacatgactcctgcaaggtcacacagagcatggaggaaacaggaccagagcctgagacttgagtccaagtaccaagtccacagccgccaagctacgctgcacagactgcagggggttctggaacatgagactctgcagacccaggtgttcaccttgaatgcctaaaattaaaaagaaaatccttccaggggtaacgcaaccaggagtgggggaggttaattttttaatcagtcagatcgcgttatagttccaaatgtaatgtcacatttttaggaagactcctggaaggtcaacctaaatatatatgtatattctgttcaatgctggctttttatctgctcaagctctcgtccttgacgcatgctaatttagttctatttcattgtaggatccctgcagacaccataagatagaagccccaaccatgatttataagaaaaaagtaaaaggaagtaaaaatgttcccttagatcaatccatttgggttgctctgacctagtttctggtttctaggccaggctccttaggccgtggaacaagccatgattgctcactctccgtatccaaggccagagcggagacttcccgttcctctatcttttcccttgcacgaatcacatttcctgattcaaaattctcaacattagtggccttgagaaaaacagttaagttctagaaggaaaataactaagtctatagctgtctataggttgtacctgccttggctttgactctttcctggaaaaacacaaacatggatccttgtggaatgtcgacgcctccatgtaaacagatttcacttccctctgctaggagaactccacaaaggagtgtggagccactgtttatacatggggaggaaatttatcaggcatgcatttttaccattatgggagcaaattattaaccctgtctcaaaaaaaaaaaaaaaaaagtgtgtgtaggtgcttcgcccatagtaaatgctatgcatgcatatgatggtgaatgaacaccccctacatcttccttatttcatggtaggaccctgaggaaggggcctaccagatcataatgtcacaagcaaaatgaggactggtttccacaatggctgagtgagtgtgcacagagctcagaagctgaggggggtatgtaggtggataaaacaacaaagtgggtcccaccaagctaacctcaaactactctccagaaacaacctagagcttccagaatctgacaatcacctcttcactaggatatcatatcaggaacagcaactttcttcatttgtaagatgtacttcttccctagcactattttccagctttcccaaatttaggtccccatacaaaaataaaagcctcctgatatagtttggctgtgtccccacgcaaatctcatcttgaagtgtagtccccataatccccatgtatcatggtagggatctggtgggaggtaactgaatcatgggtgcagttacccctgctgctgttcttgtgacagcgagttctcatgagatctgatggttttataaagggcttccccactccttcactctgcacttctcttcctgctgccatgtgaaaaaggacatgtttgctcccctttccatcatgattgtaagttttctgaggcctccccagccatgctgaatggtgagtcaattaaacctctttcctttaaaaatcacccagtctcgggtatgtctttattaatagcgtgagaacgaactaatacaccgccatatacacattactctagcttgtgctcatccaactccacgtcaaactgttgccaataatgatggtttgtggggcactctagattaagcagcccagttgaaaaccctcactctgaatctcactagctgtgccacgtagggcaagtcacatacactgttgggtctcggtttccttgtgtgcaaaacagggacaataacagagcctcatttcactgctgggaggattcaatgggataattcatataaaatgtgtctgatacacggttagccttcataataaatgaggctattactaatgttatttttcatcagttaatcttcaggattagggatggaaacgaacatctactgaacatacctatttgttatttctctccttacaaccaaccctcactcctccccaggctccaaaaggcaatccttggttgacaataaagaaactgatatataggaattatgacatggacagaggatactgaacacacacagggctgccttcacccttacaagaagtgcaaaacttgccaaagtcaggctgttggtgtaggcagagcccagatccaaagcttaagcccatgcccttgccaaaaaaaaaaaaaaaaaaacaagaagtgtttactgggtctgtttgcccatcagggcaccaatgtaataaaatgcaaggaccacgttctttctcatgtctgccaatatcctgggtgaggagcagggaagggaggagagttcggctgaaatgcctggaagacacttccccgattctccaaatccactcaagaatttgcttatttgtatctccaatcccatgacagtcaatccagcagaaaaaaacacgtgtctactggtcaaaacgggtgtgctacttcatctataacctggagatattttacttgccctgtcttacacaaagcaattttaaaaaccgcatgagaaaacttccacatatgtgaaaatccttcggaacatgtgaagaactacccaaatatttgagacagtgatggtctttctactgtaagtccagatgttgcttcgtcgcttctgatgggcacgtacagccaggtgggcttggtgatggatgatgccactggtgttccagctcagtggttctctaacttgagcgtgcatcggaagcacctgggaggcatgctacgccctagatcgctggggccatcccaagggtttctgattcagagggtctggagtgagccccaagaatctgcatttctaacagtctcccaggtcatcatgacgccgatctgggaccacactttgagaaccgatgctctggccaggacagcaatggccacggaaaaaggacccaagtcggaatacctggagatgttctgttgcagggaggaaaatttccaagaccaaaaatctctgcacttggcttttcccaaagagtatcttaaattctagcaaactgcacttgataaatcatgcaatgcctgcacacaagaattcacctccttaatgaaaaagtcacacggaagcagctgcctgctactggcctgctccagatacttcataaaagtcagaattggctctattcatcttcctctcccctttcacacctgcactcgaaaatttcccagggctgtcgctggcagcgtggctcttgatgggaaagcatgaggcatcattttttcctcccttgctctgcagcccgctgagtgcacctgcccagatgtcttgctggaaccgagcctacagaagaatttcaaccaaatgcgagaggaaaatgctctttaaaactcctcccatgctcttcaactttctggttgttgctgcagagcatgaatttggtgctcaaacccagaggctcctcttgagttcctactatttgctgacaaatacattcatcaccttcataatgagagaagacagggcagccggcgcaacacaagcaggaggtaagcagcacccacaaggctgccttctgcctcgtacaaggggcttgattttttattttattcttctcttaaaagagagaatgagaaagtgacggggcgaggcagaaaaactccctctaaatcaacacttctggcgtcgatcactctggctgatgcagacatttcactttttctccttaaattccatttgttttctggaaggttgaaagagacagacttgtcggagggaagcaagggaccaacagtgaaatgagaaagatggttctttgaggaaggacagaagagtctgcttcaagaggccaggagatggctgtatgcagaacggacggccacgtggcgagagggccacagttctgcaaacgatgacactgctcatttcccagctctgcttttgggttcccccataaataacccagacaaacaccccatgcactgggttctgccctccttcccccaccccctttttaagtctcattaaaagccgatattgttccgcctcaagatggagagctcagcatggattttactgaacgttaaatcaaccagcaagcgcagccagcaaactctgtggcactttaactttaaataatgcaataattattgaatttcctttttataactgaagtgctggaatgtaaacaatggggctgtaattgcaggaaggggggatcaatagaggcaatcgttttcaaccatgttaattgtaaatacaattgctccaagatgtcagccttgttcttcttgctcccagaatcatcctaacggatgacagagtccaactttcccattacagctgttcgttcctttaagaggttctcaatcaggtctgatcaatctgtcaagataatgcatggagtaagtaagactcttccaaacacaggctcccaatcaatagcccggaccagcttaatgaggtggggctgaggcccagagggaggtaacagcccccagcttgcgcctgggtttggcaggctggcttcctcgcatggccctgataaacagatcagcccttaatgaggacattagttatgcatgcttcagcaagcagcaaggcacccgtccctggggacagacggacagaaaacaaaatagattaacagaaaacaacatggtaccaaattaggtctcactgaagacttttccctccttttcctgctttccttaattgtccagcagagtggaggacaccaattaatcattccaatgggcctgagcgcaaagacctatgggcatcccctggggtagaggatctcaagctgtccctgaatatgagcaccctcatttttgagacaccgttttcagagcacaaaggggctgacggggggctgaggagcctttcatggacgggccttagcaccaaacagccagagagatggaggacaaggctgaacctcaaagtctgacagtcgcgcaggccagccgggggctaaagttggacaggaacaaaaaccgccactctgaggctgatgtccaagtttctgaggccaagtcttggtcttgagaatggttattccttccagatgaggatgtgggaagtcaggagtcttgaatgcaactgcacccagcccggtactgcaggagtctgaattctcaccaggataaccagagagggctctatggggaacccatgaggaagggacaccatcttcccttcctcagaggccgctgtgcatttgttcctgctgcgagagttcgaggagggtgcccactgtggaggtcgttgagaaaggcccatgctaagggcaggtcccgccaagaatccagcagttcctttcatgcttggcttagagcagggagttctcaaagtgtggctcctcaaccaacagcaacagcaccctctgggaatgtcagatgtgcaaattctcagaccctgtccagatcgacagaaactctagggatggggccaggaatgtggcttttaacaagccctctaggcgattctgaggcaagctcacttggtggccactgtcttacagtgggggttagacaaggcaggcttctagtagggataacctcctcatatgttacatggagttggacctttctggatcggaaatagtccagatgcccaagatatagctagaaaaccgtattcttactgaggtttggctcagaggaggaactattattctagcccaccacccatctgctccagaatgcaaggcccccgggaaaaataaaaccaaaagaacacagaggcccttgtgacaactccattttattagttgagaaagatcatgaaatgggtcgcactactgaatttcagaagttaacagtctcatattgtgacagaagtaaaaacgagaataactgggtcttttgaaagctctaagggatcagcagactaagagaaaataaatataccgctagaaagatcagatccctgcactatgcagagacccagctcacagaccactcctactccaaagctgtccccaagccccaggctccatcgcttcctcctctgggcccttcagcccactggaagcagctcctatgctgtgcgtgttgcaaaccacctttgctcctccgccacaccatcaacagcatcccacaggctgggaccaagtcgaatatttctatcctcagttctcagcacagctcctgattcatggcagggacttaaaaactgtagtggctcacgcctataatcctagcactgtgggaggccaaggtgggtggatcacttgaggccagaagttagagaccagcttggccaacatggcaaaaccccacctctaccaaaaatacaaaaattagccgggcgtggtggcaggctcctataatcccagctacttgggaggctgaggcaggagaatttcttgaacacaggaggtggaggtcgcagtgagccgagatcacaacccactgcactccagcctggcaacagagtgagattctgtctcaaaataaataaataaataaataaataaataaataaataaataaataaataaataaaaattgtgggctgaaagtttgaacagatgaagaaaatccttctaaagctccactattcctcctgggtcttcagcttgcctttcaagacctatctaatccagtccaaattcacttcccccatctcagatttcaatcctccactccattccacttgcaattagacttgtgtcagttcccaccttccccaccaactatgatctttctggtctcagtgccttttcttgctgggaaaccctcccagataactctgacccatgctgaaatgcctcacatctcctacggcaggctggtggcacctgcgcctggaaggctttatgcattgcacctgagctaaaacagtggctccttgcctgtggggggggtcccacagcaccaggtggtcccgatcagggcccaccacaaagcattctcttttttctttctttctgagatgggagtctcactctgtcacccaggctagagtgcagtagtgccatcttggctcactgcaacctccatctcctgggttcaagtgactctcctgcctcagcctcctaagtagctaagattacaggtgcccgccaccatgcccagctaatttttgtatttttgcatttttggtagagacggggtttcatcatgttggccaggctggtctcgaactcctaacctcaagtgatccgcccaccaaggcctcccaaagtgctgggattacaggcatgagccactacacccggccctttcttttgtgtagatgcttcacttgatttctacacggggctctctgtccctcaatgactgagatgggaggttgggggctgaagagaataaaaatgtttgctaatatttattgcttgtttaaataagatttaatgacaggagataattacactaaatggctttattcagtgacttgaatttttttagtatgtgaatcacaaaagggctcgcccctccccaccaatcagccacaatgtcccccagccagaggacaactgagttggtcctcctcattccattcctccatttcttctacatccctagctatgttatttacataggtttactatcactatgctcctttactattaaactgacaaataattgcaagattcaggtatctgagcaccatcgagacgatcaagaccacagaagaaaggaagagggagtacactccgcagatgcctcccagggggagtaactcaggctgtcagaattctacatgtgtgcgggcagtgttcaccacacacacctttgcagataaaaagaatgtggtacatattttagttctaaacataaaatgtccacccaagccaacagagtggtgtgaaagtgttcagatacctggaaggcagtggccacacaggcattcctagaacataagacagcttgtctacagctccgatgagtcagaatgagggggacatcttttcaatacacacatcacacgtacaactttattttcttcctgaatttcctgtcctcctaatctaactgttgccagggactgctgctgactggatccccaagtcatataacccacgtggttaaggctctcaccttcctctactctccattctaggacctaggaggaatggaccattctctacatggggtcagagttgcatgttcagatgtgattccttccctctccagctacgcccaaactctgggatctccagccttctgactggccaaccccccgataagatccctcccgggacatccaagcaattcgatccaaagatgccgcctcctggttggtcagctctccagctcctagtggaatgagactggaaggccggcccgggaaaacgttttaaaacttatttttaagtggcaaaatacagggagaattttcaccagccagtccacactggccaaaacatcccctgcttacactcagtaagttcactgtactgcaggcccaagaaacagtgatgacacaggaagaagccgtggtcgatgatcgcactgggggggcatgggaccggggtggggagcatcgccaatcttattccagacagatgatagtttacaaaaccttctggagaactgtgaggaatttccttcagtaaaaatcaagtcttcagaaaactgcaccaaaaaagctggccgggcatggtggctcacacctataaatcccagcactatgggaggccgaggcaggcggatcacctgaggtcaggagttcgagaccagcctggccaacatggtaaaaccctgtttctacaaaaaagtacaaaaattagccaggcatggtggcacgcgcccgcagtcccaacaactcaggaggctgatgcaggagaatcacttgagcctgggagctggaggttacagtgagccgagatcatgccactgcactccagactgggcaacagagcgagactctgtccaccccccttccccccctcaaaaaactaatgactgggaaaattttctttgagcaaaatggtaggagttggggaggagcaaaggaggtgggtggaagcgaggactagagagaggactgcccagaccctgccaggtggaaagcatcaggacacatcacgcatgctacaagtttttatgtgacgcgtgcacagtggcatgtggacacagacctggccgtgctttctcccggggctacagtattaagatgcagtcaatcgctcaccatcacaccagtgggcaagtgatgtctttttggaatctcaaatccagtagcctgctctgctagccttaatctagtcagtctatggacgcttttatattagtaggtattttaaaggcttaagtcttaaaacacaaatctttcgatgacctttccagatgactctataatagcataaggccagaggaaacagcagcagccagtctcaggttctggtagcactggtatttttataatggtctttcttccggctttgattcattcattcattccccgtgtgtctgtctacattcctgctgcttctttcctcacgctctaatctctccccaaaatgagtgttcatcaatcacctctaaaaattatcctcatcattctctgtacgtgagaaaggcctttcactaaagggtctttatcacccactactcccctgtaccacccctgtctccagccagcagctctaccggttctcggtttccaaaggtttcctctatttgtgtgtgtgtgtgtgtgtgtgtgtgtgtgtgtgtgtgtgtgtgtgtgtgtgtgtgtgtgttgtgtgtatgcacacaggtgcaggctcaggccacttcctcctgtgtacaagtccatgctagatcctccaaattccttttttttttttttgatggggtctcattcttgtcacccaagctggagttcagtggcaggtggcaggatctcggctcactgctacctctgagtcccaggctcaagtgatcctcccacctctgcctccagagtagctgggaccacaggcccgtgctaccatgcccagctaatttttgtatttttagtagagatggggtctcatcatcttgaccaggctggtctcaaactcctggcctcaagtgattcacctgcctcggcctcccaaagtgctgggattacagcattagccaccgtgcccagcccctgctcctccaaattctatcctcctttctaagcatctcacctcccgccctttttctgtctgcagcgatcctttctcctctgaactccaagtcttgggctctcagcacggctatgggcactgctgccctgagtgctggtaatcagctttatgtatgtggcacaccccccagtgagactggaaggttcctgagggcagagatgctatgccctcctccctggggattgacacacaggagccacgtcattctgcagtgagaacatgggaatgggagtgagcagccgtggagaagagggaggactgacgctgagctttctcttccattgtaaaaggaggaatagggccacctacctcaccaggggccatgaggcttgagtgagaaaatcagtatgaatgaacttccttaaacaataaagcaaaattaaaacaaaacagctgctcaggtgacgacaatgggtggaaaggggaacttgaagattcaggacgcctcccctgccatctgatttcatcagggtcctaggactgactacacaaagaggaattgattacttgatcgtccgttcacttaccttgctaatgaaatcattgggtttttctggggaagaacctgttaggaggactggcttgcctctgggtgtcagtcccgctggtgccagctgcatccccaatgccaacatgactcatgcgatgacacaaattgccattgggctttgttattatgtgaccttcagcaagttacccgcccgtccctgctccagtgctaaaatcagcacggcgatacgagaacctacttcaaggcatcatcatgaggaacgatgatgaagcagctaataatgactgggaaacactttgtctttgtaaagagccatattacttaacatttagaataatacccactgtttcaggttgagaaagcattcagattttagctaaactgaaggctgagcacatccactaatgagcactgtccttcccatagaaacggcgaaagctactcagtctgctgaataaaatgactagcagtacattagcgagaagcggatgcaggtttagttaccatgaaaccagggccattgcattcaacatctaataagcaaattcttacgatcacagaaataagccagagcctaccgagctgacaacaattgcatgaaaagcggtttggggagaataatgtcttagtcccagttttcctagaattcataagaatacagcctcttagaaggcacgtttctaaaatgtaggcaaggggtcagaaaactttttctgtaaatattcagagggtaaaaaagcttaggtttttaaggcccgtaccatctctgtctcaactactcaattctgccacggcagcacataaaagaataggcatgactgtgttccaataaaactttatttatggagacaaatggctggctgtattccctcctctggcagtgatatgctgttccctgacctaaaaccccgtaacaaatttatacaatcatttagaaaaatcacgcgcctgctctcaataaagggaacatatacattatctttctctcacacacaccctcttaaacacactctttgataagcaaaataagtttcttacaatttttgaaactcaagttaagagccaggctcaggccgggtgcggtataatcccagcactttgggaggctgaggtgggaggatcgcttgagctcaggagttcgagaccagcctgggcaacgtggtgaaaccctgtttctacaaaaaaatacaaaaattagctgggcatggtggcgtgcacctgcagtcccagctacttggagggctgaggcaggaggatcacttgaccctgggaagttgaggccgcaatgagccaagatcgtgccactgcactctaccctgggtgacaaagtgacaccgtgtctcaaaaaaaaaaaaaaaaaaaaaaattaaaaagccaggcttgcaaacttcatatgcaaataagctgtttcaacgtgaaagtcaacacctatttaagagccatttaactttcaattacgaaatgaattcagaacaattcaacttcactgcttgttttcaaggctttcgaacctaactttctcgtcagtgtgctcagtcacagggcactggttctcaggttctgcatctcactctacaatcaaggtaaataccaccacaggaataagggttaaggttatacacttattcagagcttaacaatacctgtaactgacgccactttgaacgaacctagtgatggaattactaacaacaacaaaaatgtggccttctgagtctacgccttccagtagctgaaaacaatccagttttaaacagccagggaggaaaaaatgagaaggtgaaaaatcaggtcattatcatccctgcgtcatgccatgctcttgcttccttcctaagatgctcttaagagctgacgctaggacatccaagaatcttggatcctgacatctaagaacaagtgatcaggaaatctggattgagaaaaatgaagtatttaggtgttttctcaataacatcatcttacatgtacacagtcctgcgtagatttcaaagggtttggccattacacagctcaaatgattctcataagcaccttgagacattaggcagtggatggcagcgtggcagatggctttctcctctgtttaatggacacaggagagagataatctagagatggcaaattggcagtggctgagaagcctgcaggtgggagcttcataaccctcgggagtttttaaaaatgcttaattaatggtgaacatttaaaaatctgccaatttcccatacaatcaagattttttgcctctttagacattaaaaaacaaaacaaaacaaaaaaacagggtttctggctgtacattccctcatgtcagcaattacctagaaaagatggtgcaggagccctccagccccacaccagttacccacttctgatacctgtatggcccctgcaggcatctgggtttgcaatccctgggtccgaatgtgaaagagaatgtggctggcaagtaggagtcacagaagtcaaccctgggatctaccattcctcggctggggtttgtcagcccgtgctgtgctactccgtgaataacccagcacaaagattcccctacaaaacatcatgttgctgcctgggttgcacactgcaaaacagaaggtgagaagctcagcttcaccagacttgggcagtaagggagtcgagaatgagtgtagcttcacaagggaagccagcttaattctgccacaggagttaatatttgttaattggtagaaaaaggtaaaattaatgaggaagttagcatagctatttaaaaacagctccatgtttcccccactgtaacacatggaactatcaggaagtaattgagggaaaaggacactgtcaattctcaattatctgcatgaatgaagcgctcagtgacacggataatccaagtcacttacatttggatttagaaagtaacatctttttccttcggaaaacttaccttcctaattagggcttgctgaatgcagtggcgaaatcagtttaccttctcggtcagagaaacaacgtgtcggggaaggtttggaaacggctgggcatttcagaccctccgcggataacccagggcagataaaagatcattcacagaggctggccaatatagcagccactagccacatgtgactatttaaatttaaattaagttaaataaaatgaaaagttcaatccctcggtgacactagccacatttcaagtgctcgatggccccgtgtggctggtggccaccacgctggacagcacagatcacagaacatttccatcatcacagaaagttctagtggacggtgctgaattctagaccaacaatcacatctagttacctggattaagtagaaagcagagggcagggggagagggatgcgggagacgtcacactgccactttagaaacaaaagggaattgtaactccggactctctcagctagtttaatttcaagcccggtaatgtagacgctgtctagggaataacataaaaaataagcattccattctaagtaaaatgaggctttttaattaacaaagcagaaaacgggaggataaaaggcgaggcaggaaaggctgattttcagcaaacatgtgccattgctgcctgtacccagcatggccatgcagcccagacgctggctgaagggtagacaaaggcaggagctcgaccctgccaggctccgcgcggggaggtgcctgctcaggtgccgctgggagcaatgtcaggcccagtgtcacttaacatcctcattaattatcttgaaaggagagggttagtaaacagcaagttaattaaattctcagatgatgctaatttgggaggctttagaaagactggcaagggcagtggcaatataaatgggacctgggtgggttggaggtatgagtggaaataacattaagcgctggccaaacgctgctcttaaataagtcttatggaagagccaaaatacatctgaaaagaaacttatttggaaaattgttgcaggaaagctaaaaggttggaagcttctaaggcgtatgatcagaatgggagtcaaaaaggctttttaagactttgaataaaactgtttacgtgcacttagaggtctgggagaaacagcagctcctaagggttgctgtccttgggagggaggataggagcgaatggggagcagggatggggcttgcacttttacttccttttcttctaaatgaattaaagatttttattattattttattattattttttagacagagtctccctctgtcgccagcctagagtgcagtggggccatctcagctcattgcaacctctgcctcccaggttcaagcgacttcccggcctcagtctcccaagtagctgggactataagcacacaccaccacacctggctaatttttgtatttttagtagagacggggtttcaccacgttggccagaatggtctcaatctcctgacctcatgatccgcctacctcagcctccgaaagtgttgggattacaggcgtgagccaccacgcccagccctaattaaagatttgtaaaacaggcctggtttttgaattctgattttgaaatttttgtgtctgaaataacattagatttatagaagagttgtaaagatacaatgagttcccatgtgcccttcacacagctgcctctaatgtcaacatcttccatcttaacagctgggacactgtcaaagcaaagaaatgagcattgctacaatactatgaccaagctacagactttattcagatgccaccagtttttctactcaaggcctttctctggtccaggatccaaaccatgtccctgcatagcactgaaatgtcattctcctccatcgcctccaatctgtctttccttgtcctgaaagacctgggcgcttctgacaggggcaggtcagtagaggacccctcagtgtgggtttgtctgatgttttctcacaattagattgagattatggatttctggagagaatgccaccaaggggaaggacccttcccatccaccgtatcacatcaggggctatgtgacatcaacatgacccatcactggtgatgttgaccttgatcactttgttaaggtgacatctgctgggtttctccaagggtaagttaacacttttctttctccagactttactcattaaaaagagtcactaagcccagcccacacttaagggcaggggagtgaagctccaccttctggttattacgctgttaataaaataaaaacatctcgtaaaagagataaacttctctttatgcaaacaaaggtggctaatggaaatgtctatctagaaagtcagagtttgttgtctttgttttgcatacctgggctctcgacaatggaaatgaagcaatgccaagagattcagggccctcacagtgccaggccaggtgctgtgtagctatagatattagcccatttaatccccaccacagccagatgaatgagatggcacaagattacaacaatcctcccaaatgacagtaggtgaaatgtggaaccaagaggttaaatcacttgctcgtgttaacacagctatgaagggacagaggcgggatctgaacccaggccccctggctctagagatcatgctgtctagagacctctctgctatcctgcttcttgatatacaactctgaaatttcagggcagttaaaatgcggcagcaccatgtcactcccacagtggcactgtgagtgacagcgctaaggaggcccaacaaaaccaagatggtctggagggttttcaacagaagacagtccgccttcatctctatagtgtggcagagaatccagaacacattagcttggctaaggacctccctctctacaaacaggtatggaagaagctcagaacccacagaccacgatacttactcccatctcagcccctatctactacagacacaaacttggaactgtctccaaaaacatttagagttcactgtgacaaagcaataaagctcagaggtcaggaaaaaagcgatcagcaggcagacttgggggagaaacttggcccacaacacccccgatctacaacctgcaaatatttactcatgggcttgtttaatcctaacatttgatgttctgacattaaaaaagaaacaaggaagctcttgcttctagagaaacaagaaaggaacaaggaatgtttgggtaagaactgctgcattcttacccaaaagaataacataggctaggctgggtgcggtggctcatgcctataatcccagcactttgggggctgaggcaggcaggtcacttgaggtcaggactttgagacaagcttggccaatacggtgaaaccctgtctctactaaaaatacaaaaattagttgggtgtgatggtgtgcgcctatagtcccagctactcgggtggctgaggcaggagaattgcttgaatctgggaggcagaggttgcagtgagctgagatcacactactgcactctagcctgggcgacagagtgagactccatctaaaagcaaacaaacaaacaacaacaacaaaaacacataggctaacaagtagcctacgttattcaaaattcaaaattccagtactgatctttaccatcatcctgtccacagagaaaagatgatgaagtgtgtaggaagcaacaaatgtcccctacctgcacacccgccccacactggattctccaaatatctggcatttatttctcctccatttaaccctgtcttttgttttcccattgtgtcaactgcaaaaatttgcctttaaaaaaatgacactaataaagaatcacaccatacaaattctaatactatattgatcccatcagtgactgggcagacagcagatcttccatcaacacctagactcgcagaacacatcaaacagaaggctctcgacacccagtgtccgggatcagcgtggcgggcctctgctccaacctgtccacccaactagatctcaagaggaaaacagaattgccacctctcaagactgaggctacgtgcagtggctcacacttgtaaccccggcactcctggatgccaaggctcaagaggagcccaggaagtcgagaccagcctgggcaacaaggcaagatccagtctctacaaaaaataaaaaaaattagccaggtgtgtggtacatgcatgcctgtggttccagctactccggaggctgagggaggaggatcacttgagcccaagaggtcaaggctccagtgagccgtgtttgtgccactgcactccagcctctgtgacagagcaagactctgtcataaaaaaaaaaaaaaggctgaatttcattgtgattttaaaagcacatataatcattttataaaatgcagaaaagtgttattaataagttaatctctgagtgcttactatgtgccaggcacagttccaacgcccattctaagaatcacccactctagacgtaactacttaacatttcaaagtattcttttccatgcatttcaacgtttcacttcagccagaaaacataaaatagcattgaagagaggcatattttctgatttttaatggcatcagaagctggaaatgacggactggaatagtatacgtggcaaaaatctaaaataattaagaagatgtttgtaagcacttagaaaagagagcagtgaatcacttacagagcaagagactgacttcttccttgactcttcacttcccccccctcctccgcctttctttttctcaaataaggtgactactgctgttattactaacaccgaactgggagatcagggactattaaagattaatgacatttgattttgtatctcatgatatgcttgtgaacaatctggaatggggggatctaattatactatggtaagaggtctctgtacttaaaaatgttggcccagagaatgctgatgataaatcaaagtcaacatggaggaaaatgcctgcagtaaaatataattatccaggtggacctctcctgtccagcgtttctaataagatgtgaacagagacagaagtcatgcctatcacccaacaaagttagtcaaaaagtcatatggggaagaaacaggtgaaatgtaaatcatttgtacgaattgactaacgaggattattatattttaataccaggcagtgcaaaactaaacaatggagacagttctgtatggccccaagaaaaggcgaattaataaaaaaagaaaatgtctagaaacagatccaaatgagaacttcatgtatgatatagtggcatttctaggcaccacggcaaaggatgggtagattgcttaataaacatggcagggacagataattgagaaaaaaataaatagaggaacccctatctcacagtatataccaaaataaactccagatggataacagagttaagtgtcaaaacatgaaaccatgaaagactaaaaggggatggagtgaatgtgatcttggcaggggaaagacagttctaagcttaacaaagcagaagaaggccaggtgcagtggctcacacctgtaatcccagcaccttgagaggcccaggcaggtggattgcttgagccaaggagttcgagaccagcctgaacaacatggtgaaaccccatcgctacaaaaaaaacacaaaaattagccaggtatcatggcacgcgcctatagtcctggctattcaggaggctgaggtggaaggattacttgattccagaaggccgaggctacagcgagccatgatcacaccactgcactccagactgggtgacagagcaacaccctgtctcaataaataaataaacaaacaaaggagaaggaagcaaaaatgagaagttttcgccatgtaaaatttcgaaactttggaatctcaaaacataccataaacagcaaaagataatgataaactgggggaaaggtagacagtaacacaaatacataaatacatgtttaacacctttgatagagaaagagctattttaatttgtttatattatccatctatgaacgtttaatttataacagtgaaaaactggaaacaagccgactatcaaacgcccagtaactaaattgcagcaccttcataccacggggtgtttggtgcagctatcaaaaatcatgttgtagaaaacatctagtgacatccaaaaaaggtcacacattgtaaagctttttagaagccagttacaagatacacacagtatcatttcaattctacgaaataataatatcacatctgtacagaagaggccaaaatgacatataccaaaatgtttaaaatttaaagcatcttggtagtgaaattagggatgattttttgtgtgtgtgtctctgcatttccaaaattttttttacatacaataaacatgaagcacttttgaactcaaaattaataaaaataattaagtggaaatatatatgtgtgtatataaagacgatcaccttactgttacattttcagatattataaacttgagagggcagccagctagcccactgagtcaatggaataaacacgatgaagaaaaacagcaataaatgtcaagttccttccccaggttgaggggacaaggaggcctggtttaactgtcagttccatgagggcttgagatggctgcttaataaaagactagaacattaatgacttggtgtctatatcaaggaaagggacagactccctgtgatccacacgagtgaggcctcgccaaaagaccacgtcccatcaaaggcatcatcattcaagggacctgtcaacaagcaaataagtcaaaagcagggggcaaggatggtaaggggtttggaaaccatataaagaatagtcacaagtgcttgagatttgcattcaggaggatggggacggtacatacacatgaagacaagagacaagaaaaggagggacaattagctaaactgcttatggcatcttcatacaataatactacgcagctattaaaaattatgatggaaaaaatagtgacattcaaaaaatcaaatattgcaaagttttaaaaagtcacaaaaaccagtatcctttaaacacttacaaaatcatcatatcacaaggaagatgtctcttctagaagaggaacaggacaaaagtatctctacccctgcaggtaactaggcagccagtaactcaacataaaggatgggctttatgataattaaaggtggccctggactcctttgtataaagaaatggaaatgttcagagaatctctatgacctttgtttaaaggtagttctttttttttttttttttttaaatggagccttgctctgtctcccaggctggagcgcagtggtgaaatctcggctcactgcaagctctgcctcccgcgttcacaccattctcctgcctcagcctcctgagtagctgggattacaggcacccgccaccatgcccagctaatttttttgtatttttagtagaaatggggtttcactgtgttagccaggatggtctcgatctcctgacctcatgatcttcctgcctcggcctcccaaagtgctgggattacaggcgtgagccaccgcacccggcctgtttagaggtatttctatacgatgttcctttgctgggttcagtgtgttccctaaatgcgggtagatgtgcctggaggttgttaaaaacacagattctgtgcatttccctaatccaggctcacaggatcagtctctcaggcaggacctcagctcagattctgtactttttttttttttagagacagggtctcactctgttgcccaggctggagtgtgcagaggtatagtcacagctcactgcagcctggaactcccaggctcaagcgattctcccacctcagcctcccaagtagctaggactacaggcgtgcaccaccacacctggctaatttttgtatttttttgtagagatgggggtttcaccatgctacgcaggctgttcttgaactcctgagctcaagtgatctatctgccttggcctcccaaagtgctgcgactacaggtgtgagccagtgtgcccagcatattttgtacttcaaagggttctctcactgattctgacgcacagctaggtttaagaatccttgagccaggtggtatctttatttttaagaaagatctgttttgtttttttttaaggcagtacagaaagaaatgtataaatcatcacattctatcactaatgtgaacattttttaccaatatccatcttgatatctcctgtctatctatctaaaatatacctccaattttacataaacgcaatgatctgtatatgtaacatttttatactatgttgagagaggccgtctttccaactaaaacatgtatatgcaccatcttttttttttttttttttttttttttttttttgagacagagttcttcactctgttgccagggctggagtgcagtggcacgatctcagctcactgcaacctctacctcccaggttcaagcgattctcctgcctcagcctcccaagaacctgggattacaggcacccggtactatgcccagctaattttttgtatttttagtagagacggggtttcactatgttgaccaggctggtctcaaactcctgaccttgtgattcacccgccttggcctctcaaagtgctgggattacaggcatgagctactgcgcccggtccctgcatcaccatttttaatacctgcactgtaagccacaagaacatgctgtaattatcttaactagtccaactgaagaatttgccaacttaaaaaaaaataaccaaaataaacaatgttgtgaagaagagcatctcatacatatcaacacccagaagtcactgggcctcagcacagaattagcccactttacactgtgatagctatcagtggaaaaattaaactaatacacacagccaccaacagggtacatgagcccctggattccattatgattaggaatataatcaacttaaagaaacacaccaaccaggtgcagtggctcatgcctgtaatccaagcactttgggaggccaaggcggtggatcacctgaggtcagaagttcgagaccagcctggccaacatggcgaaaccccgtctctactaaaaatacaagaaaaaaaaaaattatctggacttggtggtaagcgcctgtaatcccagctactcatcacttgaacccaggaggtggaggttgtagtgagacacgatggcaccattgcactccagcctgggtgacaaaagtgaaagttcgtctcaaaaaaaaaattaaaaaaaaacacacctagaggaaaaactgcctgtctgtgtgtcatctgcagaccagcttcctcaagtggaagacaacaacttttttagcttttaaagcaaatccaggctgggcaaggtggctcatgcctgtaatctcagcacttttggaggccaaggtgggacgattgcttgaagccagtagtttgagaccagcctgggtaagaaagtgagaccccccatatctacaaaaaataaaataattagccaggcatggtggtgtatgcctgtattcctagccacttgaggggctgaggcaggaggatcacttgggcccaggagttcaaggctacagtgaactgtgatcccgccactattctacagcctgaatggcagagccagaccttgtcaaaaaaaaaaaaaaaaaaaaaaaaaagctaatccaaccaaactcagatactcagagtgtcctcgcagaacatctaggcattcattcacttaaggacggagctcatttctgaattacagaccctgctctccctctcccgccacaccctacatcatgcttagagagctggagggtaaccgggtggtgtcatcaacgaagcttctaggagatgcagcttctaggaacttggacaagtgcttcacagaaatgtgatcgtggttacttccttcctagaccccatggcgaaaaatgcttgcggctttcctgttcttcaaagggcatcagacacgactatcgctcagcatgaaggagatacatagggctaagtgggaagacggcgcaatgcaaaagggcagaggactgaacggggatttgggatgcttgggtgctagccaagaaagactccagaaaacaatcagagggaatctcactttcatttggctttggggctattcttattctctgatgaaagcaccttaacagtacggtgagaagcatgatggagacagttggcgtggcctcgccttcccccaatgcttcgtgcagcaaatgatcactgcatgtacagaaggggatcgaggagtctggagagaaaggacggggcagagagaaaagggggcagtgcctggctcggcgcccagcgtgctgcatgctggtttcaggccccaggaagctggcgggggccttgtcctgagccaggaggagacaggccttggccggtttcctagcaaccctcaccggcagcaggcagtaccccaggcaaggctgtccagggaaaaatgaaaatggccacacgcacagatgcaaaacgaaagcaggcctgcctcccagccgggtgcggaggcaccaggggcccctgccagacagctcccacaccaaactccttggagaaacatctgggggcaccagccatggagggggtctcacttccttctcagccctgcagcacggtaggcacgccgtgaagcccacactctgccactgagtcaccgaaacagcagaccttcgcatttccacactgcaggggcaccagaaccagaaatcccactcctgggttcttgcggagaactttaatcacagggggtgacacccagactaccctatctttactcctctctttgcacccaattcctccttgcagttactgcaactcgcccctctggtttggttctgcactcagctgaaggagctttaaccctccatcctctcctaaccatccccgcattaggacggtgaggcccccctgtcccagacaaacaaccttccctttggcctctgtcacttgttagttctctatcagctgaagttcatctcatcctattccacccattatgccagtgtcaagagggaggtgtggcaatgaagaggacaaatccttacctctagcacagacagaaagggccaccatcaaggatggctttagcgtcacagaaagaaatccacctgcttgtcaccctcaacccagggaccatggtgacagccagtaccacacgaacctgagtgtggccaaacctacctacagccttatggaacgaccgtcactcccagcgctctcttcgtacctggctttcttcctttgaaattgccttgtgtgatcaaaaatgaatcataaaacatttgtttcagattgttacatgctgtacagtttttagaacaggatattctattttaggatatctaatcctaaaaactctgggaggcaaacaccttcactttacagctgacgttacagggtctgaggctgatacctgtcagggctggggacagagcagactctccccagcctgcttcctgctctgtccataccaggctcctcagattagagcactaagtccatatatggtaaagctgctagaaggactcgacgaaatgattagtatctaaggcactatactatacatgaaaattacagcaagtatatccacacatacacacacatcagagtatatgtgtatatttttaggtatatgtgtatctatgtatatgttgtgtacataaatagaagctggcatctatctgtctacaacaagaatagaagatatgaacatagggctgggtgcgttggctcatgcctgtaatcctagcactttgggagaccaaggtgggaggatcgatcgctcgagcccaggagtttaacaccagcctgggcaacatggcgaaagcccatctctacaaatgatacaaaaagttagctgggcggggtggtgcatgcctatagttccagctactcgggaggcagaggtgggaggatctgtagagcctaggaggcagaggctgcagtgagctgtgatcacaccactgcactccagcctgggcgacagagtgagacctgtctcagaccagaaaaaaaaaaaaaaaaaagacgctatgaatatatatgccttgtatccttgatagaggcaaacacctcacattatttataaaatcaaaatttcaggttaatgatttcccagagacctaatttccatggcactgatatagttgatgcgtctctgagcctgttttatacatgtcatatacagacaccaccaggagcacccaggaattaagaccattccacagcctacaacatcgcttcccagatctctgtcatgacctcatcaatctcaagtctctctccttggtagtagatgaagtagatgaagtgggagctaatgaaaaagctaaggaaatcagcaccactaagaaaatgccaatactcattcccgatcaacatacacagttgactgttttcatcctactttgaattgcctcgtcctaccacgttcaagacgcggctactgggcaggtccacgtctttaagttgtgtacaatgcctggttcacaacacgattactcattacatgtcaaaataataattatcacagatggcgaattcacaagtgggttagccgtcggctgtaacgggctagctagcacttgccccaggcactcaagttcagcagtcaaaatgctataaaacacactgttctttcttcttgttatttatttattaacatcaaggagaggctcacattttgtctttcagagttggttgcaataggttagacctctttgaagccacataaaacaattcactttgtattatgtaactaaaacttaaacgactttagatttgatgacgctatactgctatccctccttgttccctgcaacccagctccctctgttaaacagggcagctctggggcaacaccgcaggcccttcctaggaatagttcaagaaaacagcctctgatttcctacaaggacggtcactgactgtaaaactacaagaggaggtaagaaagtactacagcccaagggttcctcaacccaggctcctgttatacacctgcctttgtgtccacagtgaaaacaacatggaaggaactggttatgggttttgacataagttgtttcaagccagcagatgggatgagatgctgcttccatgacaaagtcaccctggatattctcaggccgaatgagggtgagatggtaccaggcccacagagaggccgcggctgggtgcgcagaactacgacaccagccctaagaagccaacaggctgttgaatgccaagcctgaactattaatttgcatatgacatcaattctgctgtcagtgtgttaatgtgtgattaattctgtcatgggttagagcaaggagaattagttaattgtcagaaacccttctcgttcactctcgtttagcccccgcctccctttaacttccttttttctcttcttattaaactaacctcctgggttttcttcctctgggcacttctgtcctatgggacttcagtcccatttcctcctaccctttacagaaacgcacctatagacccaaaaacggagaaggcagatgggtcttactccggcgccccagctggcaagtctgaactctgtccaggcagtcacgggggtggtttgggaaggccttacaacggggacacacaggtcccattcatatttgcggtcaactgccaatgccagtgatacctggatacattgtacaatctgtgctttgtgtgctgtgcaaataacctgtggggctggagcaagctggaatgtggagttaacacaaagccattgctgtgctatcgaaatcggtcgtgaggctgcccactcttcccccacttcccagaagctggcccacttcttccttcctaccaatccttgcccaccgtcaatgcagctgtagagtgagtcaactgcgcttttaccctgtcaacggttccatcactgagctagcttatactttttaaacacaaagttcaacacaaagaaccttgaggtccctaactctggaaagggcaagagaattctagaggcccctgaatgccaggaaatttcaggaggtacaggcatgtcacaggtcaggctaaatggtccccaaccaccgcagcaatgctgcatacgcacgctgtggggtcaaggacaggtgatcctgatggtcacatttcccaggtttgctaacaggcagcccatacctgtgtccacttaaccccgtcccgtgtctttcccttatcttgagttgcctttcactttgaagcaatgaggaaaaaggaatgaatgaaagcaaatggacccgcacaatcatctacaatagtccagaatttgtctaatttatagggctgggaaaccaagtgtcaccttcgggcctactccttccctgaccaaactgcccagaggggctggaacgggcaccagccaagggtgggcagtgaccatagcttttacgtcctcttgaagacaggaggaaaatgcaaagaggcacagactgctactcccctgtcccccactactcattatataacacatgtcagtttcttgaaagggccctatatttgtgcacgaaagcatgttcccaagagttaacttataattattacaatagagaggaagcaggtaactgagacctattttcacgttacaaacaaaattctgtgatctatttaaaaagcacaggcctccctttttatcttggaagtcactgtttcttttaatttggaaacacatctatcaactgaaacctttaaaaacttaacaaggaataatgttgttatgggtcatgattattctaatgtcttatcattttattttgcatatgcccttatagctaaactcaaactagatgctagaatataattgcccatagtaaccaactaaacagttcccctaagcaatgtgtatttttgcgtctctgtctctctcacactctcactctatcctgcccgcccactcgctccccttcccaagtaacaaaagccagataaatccatggaagaggtgaaagagctacagcgactccactttccaaacacttgtgtgtattacaactctttaaaaatgaattacagaatccactttgaaaaacatattcgggcccttgtggaagttaccagtcctttctcaaatgagctggaagtgtctctgatcaacatgaattggggttccttcttccttttcggagtatggatactaattgttttaatatgggcattattcgcacatgaaactagaattgctcagcacgtgggagataggtcccgaccacccatgggcatcaaagatcccatgacatttctgtaaatcagccaaattccaacacagacagcaggcccagcagttgctgtattcagatgaggggcgattacatgctcctgcctctcctacacaaagcagagaccaatgtttctactcctggcccgttctctgggtctatcctggccaacctcctctgggcacagcccatcagacctccagatggctagttctctctagaccactgacatcctacacacaaaggattaccaagaagccagctcccccaggtttacgaaatttataggaaagtctccaatcaagaggtcaggagacagagaacagggtgttaggaaccatgagctggaggagagtcccagcataggggcttctcagctgttctcacttgaaattacctctaaaaatctatttccatatttcttccctggaatttcacttttagaatttgaacattcagaaccttcaggtctccactccttcttcacttggtcagagaatttcacttggtcagtttcacttggtcagacattggttaaaataaaataatttccatttttaaacagtagtaaaaaatttttatttaaatttgtttagacccacaccaatgagtcttctccctgtgtcacagtaatccttcctccttgtcttccttctctctcaatttctcaatacccatcgagtctttccttaacaatcctcccgattcattctcccgctgggatggccaagttcttctgagggcaacacctgctccaggccgtgcccccttggcctcctgatttgccttggaatctggaataagtcagttcttctccaggtgcaggtgatgggggaagtgacatcacacctcacaaaaggaggatttgggggaacgttcagccaccgatgccctcaataaaaatatctcgtgacttggactcaaaggcagtggccttcccagcggcccgcgaggggctgggaggttcccagcatggcactggggctggcagcaggccctccgcacagccccccgcccctccggagccgcccgggggagctgcagcagcctctctgcgccaggcacactcccagcattgtgctccctccagcgcgctctcccccaccaaaaaccctgaggcctccggagtgtacactaaccacaagcctttgagtggctcatgtatttacaaactgaggcatgtcgaaatcaaaggggataccacatgacataattcgcattaaaatgtcaacaggctgacaatttatagagtcaatccacggaaggtggggaggactaagactcagtaattgtttaattcctgctgaaacccacggccactgtgcctttggaagctgggatgcgccagaggcctccaggctgcacagtgccccctggggctggcaccgtgccaaggccaggcaacgggtttaaccatttagggtgctcaatgatgtggaggatggggggaggggagggggaggggagagagggagggggaggggagagagggagggggaggggagagagggagggggaggggagagagggagggggaggggagcgagggggagcgaaggggagcgagggggagcgagagaggaaagggcttaaggggaagatggaaagagcgggtaggaggtaggagaacaggtctttccacaatgtgtgcccaattgacaaaatggcttgggttggtcccaaagagggaaagttgctgttgtacccctgatattccctttgctgtccatgcatccaggactggagatttgaatacatgcaaaagcgcccccaccacaacccctcggcccaagtcttggtttcctggctgttctctggcagcacccggctcaccaaggcaccctaaggaggggtcagcggtgtttatgataggcccccaaactctaggcccaagctccacagataagcaagaaccaagtcatgacccaaaccagatgcctgttcatataagattacccctggaagactctttgatctcttttacctccctcaccagtagcactgttctgatccacgtaagataaaatacaaattcttaggccagatatagtggctcaggcctgtaatcccagtagggaggatggcttgaggtcatgagttcaagaccaacctgggcaacacagcaagaccccatctctaccataaaataaaaagtttagctgggtgtggtggtatgtgcctgtagtcccagctgctcaggaggctgaggcaggaggatggcctgagcccaggaggttgaggctgcagtgagctaaaattgcaccactgcactccaggctggacaacagaatgaggcttggctgggtgcgggagctcatgcctataaccccagcactttgggaggccaaggtgggcagatcactaaaagtcaggagttcaagaacagtcaggccaacagggagacactccatctctactgaaaatacaaaaatcagctgggtgtggtggcacacacctgtaatcccagctactcaggaggctgaggcagaaaaatttcttgaacctgggaagtggaggttgcagtgagccgagatggcgccactgcactccagcctgggcgacagagccgccagaccctgtctaaaaaaaaaaaaaaaaaagagtgaggtaaaaaatcaaattcttactgcttaactccacctggatttttgatattggttctacctatatgttaaattaactgacccttgcttggggagaggtccacccgggggtgagggactggtgaaagggatgcaaaagctaagtttgaaaaagctctgggggtgaagtgtttgatcagctccctcaaatgcaccccaagctctaagccaagtttaatcttttcatcattacatgagaacgatatgtctagagaacacaaatggtagaaataagactatttggcaaagcttacaggtcatcatcaggatctgcattcctcagccaggaaaaactgtgttctgaaaggtggcctcgccctgtggctcttgccccagaggatgcctggggccacgcgggctgcgacagggccctccacgcaagctggctgtacataaacagtaacacctcattctctcttctacctcattaaccgaaacacattaaaacaagtgtgcactgggagcagaaaatgagactgttaaaccaagctgacataatcctcatcagctgtgggaaaggagaccgcatcaattatgctgaaccgaatgcagtcacatggatgtgctgggctcccagccccccagcatgaaaaggaggacaagaggaaaagaaacgttcacttaaaaaagaaaacaggctgggcgcggtggctcacgcctgtaatcccagcactttgggaggccgaagtgggcggatcactggaggtcaggagttcaacaccagcctggccaacatggtgaaactccgtctccactgaaattacaaaaattagccaggcgtggtggcgggcgcctgtaatcccagctacttgggaggctgaggcaggagaatcacttgaacacgggaggtggaggttgcagtgagctgagatcttgccactgtactccagcttgtgtgacaagagtgaaactcagtctcaatagataaataaataaaataaaataaaataatatacttcatactctcctaacaaacacagcttctcgcccatttttgtcaccccaagggaggggagcggcatctgatcaaaacacccctttatggttcttctgcacctaaaaatctttgccaaactatttggaattggaggggaaaaaagaaaaataaacataagcttaaaaaaaaaagaggacgggcgataaggagataatggattctgtgtgatctcttgcagacagattttataagtgcaaagtatctcgaggcccaaagtcctaagacccgaaatgatctgaacacaacccgcttgtgacataatggcaaggatgcttcagaaattaaagggctatggagcagacaatagcaattgaaagctacacagctataaaacacagccagcacttagctctttcagccactgccaatagtgaataacagatcagaactgatacatttagaaatactcataaaacctactacggaagaaaacaaaaataatgcctgtacattgccaaaataaggaagattacggttctggtaagaataaatgaccaaatcattacctacacgtaagaaatgcaaaagacttgtatatgacagtcataaaatgtaaaatgtggtacaaggtgccatcactgagccgtaccccacatcctggacgttacaatatcatatttgatagtaataactaactcacgtgaaatgagtattgctatgcaaaactttcttttgcatttcttcatttgtgttcaaatttgcaaccttaacatgtttattgccactgatttgcatttcatttcataggtgaaagtttccaaacataagctgtggacttatttcttatacacctcttgacaccagcatgaaacgtatgttgccaaaactcagtcctcctagtacccattcaattcaccattcacattacaaagagctgctctgtttttcaagtatactttccagatccacttatgcatctaatcatcaggcaggtcatgagcttggtgagattttgtttctgttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacacacacacacactcttcagctttcaaaagaggtcgggggaagggagaaaacaatcatgacttcagtagccaaggagattaacttccaacgtaccgacagggaagaggagggatgcaccatttaaaaaaaaaaaaaaaaaagtttcagctggagaaaaattttggaatattttaaattaatgggtaacaaagggttgccatggaaacagttttgcatacttgactgcaggtgctccctacagtgaagggagattgggatgatacagccacaagcaaggacactgatgtgaacattaaagtgagattcctaaggcaatgttaagtcatccgagccacggacactgtggttttcgatacaaatgaactcacttatgcaacgagggtatgtgagctttgcaacaccagctaacactcacttgcgtccagaagctgttcccccttttacgatattctgtggtattgccaaggttacaaaatgtaaacagatacaaacacgaaccataacaagaaccaaagtcaaatatattctcgtttttccatctttgtcctctaagctgtgtatttctagattgtggctttatttttttagagtgaatatgcactagctttaatcagaaaaatatacatgtaagggaatgaaaactaccaaggagtatagttcccctgagtgtcctgtgtactctatgccagtttccaagcctacgttctaacttgcatctaattttggtcacataagggaaatacatgtgtgttgatgcttgcaggaagtcctatttaaaaagaaacaaacaaatactgaaacctcccaggttatgtgggacaatatgataaaattatgtcagtgaaggtaacatcatttccttctcacaacggatgatgtcttaggtacttctcagggaaggggtggagcaagccatagccacaatgcagctggacttgaatcactttctaattttcctgagtacttcactagatcactttttgctccattacttaggagaggagatggagatatccctttgggaaaaaaaaaaagtcctacaaacacacacttagtgcttgaaggagacttagtgaggaatccaagctccacctccttcagatgaggccactacagattggccaaggttaaattactggctcaaggtcatttcactaaacatcggtcataatctctcttcagggaaattccatctccctgctccgcaccaaaaaaaaaaaaaaaaaaaaaatccactgacctttccattctccaaaccaacagcgtgtcaagttcaaagctaattaaaaccaaattataaaaataacgtcagttgtgtggtctaagaagacgatgggaaatctaatgcagaaaagcagagtccttaacacctttctgatgctatatgcagactgcgtctaggtgcatttcatgtattatctcatttaagtcattcgagagtcctatcaaagcaagtcattctattagcccattttacagatgatgaacaaacaggaattaagtcccaggagctgggattcaaacccaggcagcctgacaccaggcatcttctccctccttaaaaccccaagagctatctgggtttcctttaagacgcatggacatcctatcttaaatttttctagtctgcagcacccactgagccccactccacctgccacaccaacatgtgcccggcatctcgtgggcatccagacacctcctgaatggtcagatcccattagatttccatggcctctcccgcagtagcttgagcgctcttaaccaggtatgttactacctctagtgaaatgtatgccctcgtctgcaaaaacagaaataaccaatctgagccctgtcttcagagacacaacagatcatcattactactctcccagaggagtaggaaggtggaggggaggacagcagggattgagaagagacctcgaagcttctacacagtggagccgagagaggagagaacatttcaccattaggttttagtattttaccctcacattgcattatgaacatctccaaccaaggagatgagttgaaaaaaaaatcatacagtagacacttaagtatccaccacccagctgctgaaattaatgctttgctgtctattttacagccttctctttatcctgctatcaatgtgccttacatcttttattcattccaaagtaaactgcagaagcagtacactccacccctccccctactccagcatgcacagcctcaactacagttttctttttgtttatgggtttttattgtagttttattattttaatagatcacgtgagcagacttcctgactagcaaaacactaaaaagacccaaactccagtgtgttgttattatgaaatgtttagctcacaactttctttttttttttttttttttttttgagacagagtctcgctctgtcgcccaggctgtagtgcagtgtcgcgatctcggctcactgcaagctctgcctcccgggttcatgccattctcccacctcagcctcccgagtagctgggactgcaggtgccctccaccacgcccagctaattttttgtatttttagtagagatggggtttcaccgtgttagccaggatggcctccatctcctgacctggtgatccacctatctcagcctcccaaagtgctaggattacagaggttagccaccacgcccggccacagctttcttttaaaagttagagtaggctaggcgtgatggctcagcctgtaattccaatactttaggaggctgaggcaggaggatcacttgaggtcaggagttcgagaccagcctggccaacatggtaaaaccccgtgtctgttaaaaatacaaaaaaagttagccgggcctggtggcgggcgcctgtaatcccagctacttgggaggctgaggcaggagaatcacttgaacccgggaggcgaagcttgcactgagctgagatcacaccattgcattcctgcctgggtgacaaggcgagactctctcaaaaaaataaaacagagtagtatccacaagtatgtgagaagaagttccagttattaaaattattttagtaccatagccacaggttcagtaagtacaagaatgaatctgcctttgtcctctgtctagttcacctttctatatgattctaccctctttaaatcttgctcaaactccagcttgcccctccctcccagaggtctttttggatctaaccagttgggtgtggctgctccctcccttcaccttcataactcttgtgtccgcatttgacggctcttactgaatgatcaattcctctttgtattacgtatcacagtaatacagtttcttaaactgtggatcatgacccattagtgcagtggttctcaaactgcagccgcacatcagaatccgacagtaaatgaaaccacaacctctgggggtcaagccaggcaggcgtagttttttaaaggcccctgggctaagagtcgctggattacgaaatcaggatcatgtcaggggatcatgaaatccatgctgtgagtacaaccagcatttgtaaaacaaaacagaattgaatgtaatagaaagcatcagaatgtagcacctgcagtaaggataaaatcattctgcacaatttctgttttagtcaaatatacagaatatctagctatatgtatgtgctgggtcactcatgtaaaatgcatttctttttagattatcgtcaacaaagtttaaaagtcactgccctaaagaagcaaggacgttatcctgcgcatagcgggtgctcaaggacgtgtggcttgtacatgggacaggaggagagaagcaggtcagagcttctctcactgggaatatgttctgccaccaaaaatgtggttctcagggcgggggacaatcagatatgggactaagtaagcatcattcagacaaagacgctcgcccaaggataagggaacgaaagcaggagaggagcctctagggaaactgagggaggaggcgactcggggctgcccctaatctttaaatttctatgtttaagattccgtcttttggccgggtgcggtagctcacacctgtaatcccagcattttgggaggcagaggcaggcggatcgcccgaggtcaggagttcgagaccagactgggcaacttggtgaaaccccatcactactaaaaatacaaacattagctgggcatggtggcatgtgcctgtagtcccagctactcggaaggctgagaatcgcttgaactcgggaggggggggttgcagtgagctgagatcacgccactgcactccagcctgggcgacagagtgacactctgtcttaaaaaaaaaaaaaaaatccatcttttgccatcaaatcatcaggcgacacttgctgatagtctacctaatatccccaagaccctgggaaggctacaaagttgggtgagaataaacagatcccaccggtaaggatcttacaactaagcagagaagaaagaccactaaaaatatggtctatcataagaatgggaaaggaacaaggcattttgatgagagtgctggggagaaagagcagtgattttagttggcagaatttgggcggacagagccgaaactcacgggtggccagcagcacgtgggaattttcaaagtaatttgacaccagctgcatgatcttgccagggctgtgtctcaggggtcagtacaggaacagagctgtgtgtgaagctgatggtaaatgacctgggctgcagaagctctgcaatgacctggtccacacaagccatccactttacaccaacatatgccttagggctctaccttatgaaatgccaagtgtgcgcatgaggctgttgtacctgttctagcacagggcagaagcacggcatgctctgctggtaccctatggttcaatatttattgagctggtgtcacacactgttctaagcattagggacagagctgttaatggggcaacgtaggtctctgctgtcttggcagacaactaaattaatgaacagacaagaaaaataaatataatcactgtcaatgcagagaagttatcttgagtgaagtgatggtgtagctccttgagactgggttgtcagggaaagcctctttgacgaccagatattgaatgagagctgaatgtcaaggtcaaggaggtacatacactcagtagaacagcaagtgcaaaggccctgtggcaggcgccagcttagcatgttgaatgaacagagaaggctgctgtggctgcagtgtagggggcaaaggggagagggttgtaaaatgaggtcagcatggtgggaggagttcagatcacaaaggagcttgtaagccacagtacaaaggtgagcttttatcttaagtgaggtggaaagcctttgtggggtctttgcaagagagtgatatgacctgattttcctcttcgtaaaatccctgtatggagaggggattgtaaagggcaagagtagaggcgggggagagttgaaatacagagagacgatgggggctggcctgggagggtggtggtgcaaatgtatttttgaaggaagcacccacagaacttgctgatggtttggctgtaggggagcaaaagacaaggagccccacagatagttcccagctttttgggttaagcaaatgatatgctggaggtggccctaaccgagatgggggagcccataagcatttgggggttctggtcacagagtcctttctgcaccatgctaagcctgcggagttcattctcagacattcgaatgcaaatgccaggtggggagctggatacaggaagaggcctaggctagggacagattcagatgtcatcagaaagtagatggggtttaaaaccactggactgaatgagatacttagggagagttacagacagaaaaaagaaggggctctgggacaagcctgggggcataataacactcatcgtgaagtcacagaagagaagccaacagagatagacaaagggcaagagtggcaaaggcggctgaaaggtccggcgaattaggacacagccgacagagtcagcaacacagaaaccactggcgacctgtcctactagtggtgaaaagtgtcacttctggatccagcaactgggaggggacatggtgagtcaactcccagagtgggcatgattcagagtgaggggttgctgggcaatgcggccttgggccttgggtgccagcccccatggaggaccaggtgacttccatgagtacaggctgccagcttcagggccaccgccatgctacaccccgcagctgctcccacgccacctgcagaaggcagtacctttccatcctctctgttccacttctaccactgcagagggaaggaaggaaaacaccatctcctctcacttcctgaccttcctcctctgcctccaagagcctttttttggtttgtttgtcctatgcacgactttttcagttttccaacaatcactggtgtcctatacttcttaaccctccacttgtaaaacaacacctttcagacactcctcagctacttttcttgcaaagaaacttgctgtcagtaaagacaagagagtaaatggagagaaacggataaccacctgctgatgtctacttgtgctgcattcttgagaaactcacaaaactgaaggcaatccaggtcctcaagaggtttacgaaccagttggtgaaaccacctagcacatgacgcagagaccagcgtggtgccaaacagtgtgacacccgtgtggggcagagatgccgtgtgtgggtacagcagctggagagacagttctggaaaaccagggatatgtcactagagcataaaagatggacaggaaatatgctcttccttaaagtctgattaaaaaataaaagatactttccaacagggccccgtgcccatctcagcaacgcagggcgtgtgtaaccaaatcacacagaaatgagcacttaaaatgacatctgttggattaattagctgtgtaattagtctcccctcagcggagctgggctttgtggctgttgtctgaaatctccccaggtgacttgattccaaatgccacactccaagaggaagaaagcacaggccaggaaaagaagacaggcgtccgaatgtgtttgcgggaggcagcgggaagggagagggagtttctggagaatttggtgggtccctcgggaagctagctagaacatcagggaggaatagccatccacagaggtgtcactcgagaactcaccacctcagagcaaatcggcacgcccccaaggcatgagttttggataaccccaaagcactaaacactcagagacatgaattagggcggcaagaccctggaggtgaagagagccgagtatggattccgagttggacacaaagagacgggacagaggtcagagctcttgtccctggaggagttgtttggtcttcctccgctgacagctgcagccatcactaatgtgaacccagtctgggcaaaaaaaaattaataatgaaaatggtcagagcctaatctgagaaccagaaagtgaacaaccacgcacaaacagaagtctccagccaaatcactccccacagtgcttcctcaagcacagctggcttcggagtcacacttgctgactcatgtctaggacacatagccctgggacccgcgccacttggcctggctcactagaggagccgaggaatattccccatgcttctctatctataattattttagaaaacaagagacatggcggtagaggggaagtatagaagacaaaggcacaggagctatgggaggaccacagtgaaaaccatcttggagcaggggactcctcagctggggacgagccagtggggttacctttgatctcccccacccccatctcgaggcacagagtaccctccacagagcaaaaacatccgatgctgctcagagaaccttcctgggcctgcgacaatgagcagttcgtaaagaatctggaacatgaaacattcaaatcaaacaagccctgttcgaaaccagcaagacatgttctaaagctagatggagccactctgctaagacactccctgccataaacacaatcggagctcctcccagatcttcagtagcgccaacaggcatctgcaggaccactgcagtgacacagactcgctcccaagggcaaaaggggtctgggagcaaacaccaaaccccgacattatcattctcattgtcccgaaggcccatagatacaggctgggtgcagtggctcaggcctgtaatcccagcactttgggaggcccaagtgggcggatcacttgaggtcaggagttcgagaccagcctggccaacacggtgaaaccctgtctctactaaaaacacaaaaattagccgggtatggtggcaggcgcctgtaatcccagctacttgggaggctgaggcaggagaatcacttgaacccgggaggcagaggttgtgtgcagtgctgtgatcatggctcactgcagccttgacctcctcggctcaagcaatcctcccaccgcagccctctcatgtagctgggactataagcaccaccacaccctgataatttttttattttttgtagagatgaggtctggctatgttgcccaggctggtcttgaactctcaggctcagctgatcctcccacctcagtccccactgcagctaggaccagaggtgtgtgccgccacacctggctaattttttaaatttttttatagagacagggtctgtttatgttgcccaggctggtcttgaactcccgggctcaagtggttctcctgcctcagcctccctgtgttgagtttacaggtgtgagccatggccccaaacaagttttttagtaacacattacacattcgtgagcctgagtctgtacaaaatcctacttcaatggccagcacaaaatcagtactccacaaatgttgttgacccagggaacgaagaccccttcccagtgatttcagtctcccagaagctgcacagggaaatctgggaaatcctgtgcctcttgggtcctgagggctggggtctgaacccatgggaggagaagaagtcagggtagccaatgcaaggatgccttccacccagaacccagacttctgtctcattctgaggggcagcaggaagacacggatgccccggtgtgacacgtgccaccaagaaaactccacagaggtcagctcagaaggggttagaaaggtccagtcatcctccaggaagagcatactgccagcgacagaagacaggaagagagactcaaaaggaacagcaggtgggtgtaaaccccttcagcaaccccagtgcacaggccggccctgccaaggcaatgtgggtatcactgttgacctaagagactggctatgctttggaggctctcatcctgagtccgggaacatgctccactcattaacaggttacaaaccaaacactatcagtagataaacatttctaaccttctaactagtttgccttttacagaaccaggagggggaccctagagaacatctcctaatcattcttgatgattagtcccaatttaaacctactctctgcattccctattagcgacctatacaccataggcacacagggtctcccacgcactgtgagcaatgctcacgtgctgtgaattttcatggtctacatataagtaaccagtgcaggaggagaccaagaaggcctggagtgaaccaggggcagcttcaacatctggccaagttgctggtgaccgaaccaggcctcctgatgtccactgtgtgacgcaaaggcatttcaataaaagggactcatgaaaaaaatgactgaaaagtaagtttgaacaaacagctctagagaaaatttcagatttctttataggaaagcattttacttaacacacaaaatgtgaatattggataggacacttttctataaataacaaaaactggatatcatcattagaggcatttgtaaatttcttttgttgggaaccactggaagaaaacgggtttcacaaacaaggaagccacatagctctctttacacttctatagagcctgctggcaggtcattatgaacaaatttctaggctatccagaggtagagctgctaaacaaaacacgggatgcccagttaaatgtgaatttcaggtaagtgtaagtataatttatgagatacacttacacaaaacatcattgttgcttatctgaaatttacgtttggaggccaaggtaggaggaccacttgagcccaggagtttgagaccagcctgggcaacatagtgagaccctgtttctatttttttttaatgtcatataaatttctttttatacaaagaaaaagaatgaaattcacatcactgagaattccacagttttctttgctgtatttgccaacaccatcccaagtcaccaccctaatgttgctagtttctacagtcgccagtatttctatgagtgacagattttctgccattagaaaattttaactttcattctacatcccggctgctgtaagtgctaaaaatcaatttctgttaagtattaaatatatacttactcaatactaccgaaatggttttcatagtaacagcctttcccaccctacacttactagtatttacagtttcaactgatgtgtaaaacagaataaagtacatggttcaggtggatcatataattatttaaaaactcttgccttttcctgactatgttcctgacaatgcctaattgttcccttatgatttccctttcaaaacaaaaaaaccagaaacacctgttgggactagacgtattcaaatctgccctttgagtccaagtcctcagcaagttgaaagaattcaacattgagttcacacctttgccccattatgtggcacctgccatattggctttcctgccagagtgtgtttacctaaaacaaccgtaacacaacgcattatcctggaatgcagaagcaacggaatatttgcacaaaattctcctaagggttacagaccacccctaagacggcagatgtcatttatgcgaagaattccacggtgtgacttattcctctggatgggtggggggtaggtgaaggtactggaagtttgaggtttctctctcataagaaggtccagggctttctaaatagagaatcggggggattcgtaaatattttgacaaagtggtagctattagactttctgaaattagacctccttgctgctcagcctaagtcaggggccatggtatacctttggaatccaaaaggagacttgtaaccagtacctgaaaacagtttatactggaaatatgtcgacagagtcatgaaatttatatgctatttacgtaagaacttcaggaaagggaatttccatggctttcagaatttgttcctgaccccttttttaagataaatggtgagatccacagtctccattaaggtgccctaaaaacccagctcctctttgcagactctgtttcttctggaaactctctcatcctggagagttcaatgaaggcaaactaatctaagaaattttcttttggggaacatgccagagagaaataggaaaaggtgagaggaaggcgtttggtccacagactccaaatgccaggaaagagagccaggcctttccatcccttcttcttgttccccagtgtctccgaagacagtattccgtaaatatgttctgatttacctaaatctgtggatcattcacaagaggttctgcaagacgtaagagaatggagaatgagaaacagcttttcacaccagctaggaaaggctggttatttaagcaatcgttgtacagctagccattgaatttgaaggaaaataaagagtcctaaatcacactgcatagtcttacaactatacaaaaaatatattcctgaaaagtcacaaatagggccaggcgtgggggctcacacctgtaatctcggcactctaggaggccaaggtgggtggatcacccaagttcaggagtttgagaccagcctggccaccatggcaaaaccccatctctactaaaagtacaaaaattagcgggtgtggtagtgggcacctgtaattccagctactcaggagggtgaggcatgagaatcacttgaacccagaggcggaggttgcaatgagctgagatcacgccactgcactccagcctgggtgacagagtgagacccagtctcaaaaaaacagaaaacaaaaacaaaaaactgcatgacaaaaaatgttcccccatctacattagaacaatgaaaagggacttactttagaacaatgttgtcaatctgacaatgaaaatggaaaaacaacaacacggtgttggtcactgtgtgggagtctggccgtcacttactggggaaggatgacatggccacctgctttctgaaaggccactgggaagtgctgcatctactggcattaggtcctgggacccaacaaccccacttcatggtgtgtgtagagaatcatgttcctagctcattatctgcagtatccaaaccctgcacataacctcaaggtacatcaaaaaggagctggttaataaaggaaatactatgtcgacattaaaaagagtatctacatgtactgacctaaaatgattttcataaaaagtatctatatgtactgacctaaaagtatctatatctactgacctaaaagattttcctgaataaaacaaactgacactttgggaggccgaggtgggtggatcgtgcttgagcccaggggttcaagaccagcctaggcaaaatgtcgaaatcctgtctctatgaagaatacaaaaaattagctgggtgtggtggtgtgcacctgtggtcccagcaacttgggaggctgaggtgggagaatcacttgagcctgggaggcagacgttgcagccagccgagatcacgccactgcactcccatgtgagcgacagagtgagaccctgtctcaaaaaacaaaataaagcaaaattgaaaccacagcatgtgtctataaagatttttaaaaatgaacagtatgtgtgtgtgtacagatacatacacacatgcattttcatctacagaagcacagaaaagagcacaaaatatcaactacatgtaacagtgggtttgcctctggacagtaaagtcagaaagtagacaaaagacatccactttaaaaatcattggaaaatacttaaagatgtaaaaaaggtctcaggtattacacaacgtcattccaattttgtaaaattcctatgttacatgcaaaaataaaaatccatcacatggtaggattaaccagatatatttactttcttttttattcctggatttttccaaatttttttacagtgaacatgcattactcatattactttaactgtaaaaaatagggaatccacattttattactagcttacacttgaggtaaacatggaatgctaaccttttaagaaataattaagaatacaatactattctaaaagggtctggtcagttctttactatccacaaaaaggactcagaaaagagagagagaaaaaaaacactaaaagcatttagaaaaaagagaataaaagtgctatggttaatggttgcaaaactggtttttcaacaggtggtttttaagtactaaacttttttttttcaataggcacaactaataagatttcagttccattatgtggtgtctaaagagtggagtgaaaagatatcactgacctgatcttcttgacatgagggtgtgtaaaatgctctaaccagagtgacccacacaaagcttgtgcctaaagccatcggctgagagtgtgaaatacaacctattggacgaatgtggatgaagataggtgggaagcttctggaaggaggaaagaacaagggacctcccagcaaggtacccagctttcatgccgcacaccactggtgaatcatgagccatacgttcccacagcagtgatggatgaacttggtcctagcacaagccctgccccccaaactatttggtctttccatctcctggagtcctcttgaagttaactggtggccacaagagctgtcagagtcagcccaggctctcagtaagaacccatcaggcccacgtgcagcctcccagcccagctgcagagacccacgtcccaccagcaccaaccatcaagccacggaaatgaaccgcaggcctccagctgctccaggagaaggagggcatgcaggcgaaatctgctaaaattcaccaaaacatctggccttgcacaccttctaaatcacctgcaggaaaacattcctttcctttcattttttggttgaaggcatcaaggtagggagagaaggtggcagaagtatgtacttaaaacaaacaaaaaaaatagtctaataatgagaaaacaaggtttgaggcaactggctccagaatcccgacgcaaaccatatgacactttcaccggagcttcaaacacacagccaagctgggaaggcaggacgggagggaggaaggggacggtccccaaaggatgtatgctttttgctctcagtgcaagacaaaggcctccaggcaccacctacggacgtaaaatgtgtagctatcttcctaagacccccacttccccccagcacacccacagaggagcaccaagaatgcagatttcaaaccagatcattgtctgacttcacctacattttctgatttgcccgtctaccatacgatgattttatagccctgctgggagtgtgaatcccaatgagtttcttatgcatcagggaaagaactgaaaagatgggttctaaagcaatgcaaagtctgatggaagttttcttacattcttccgtactgcacaatcctcctagaatggcaggagcagacatcctctatgtggagaatctggccatgtgcatgaatcaataccacactctgcctcctacctcaggccaagcagagttggcttggacactggcttctcctctcctgtgtgccctgttggcccacagcagctcacatgtggcccagactcaacaccgtggtagacaaccctccttgtacagtatttaagattaacaggtaaccttcagtcttggtccaatcaaaggaaccccagctagaaaccgttttgagtaacagattctggtagggtcttaatctatctgctaaagttgacagatttccactccaatgactctcaggtgaagaaaaacatcaaagtgaaaaacagattctgggagatggtgggagtgtgcactgatttccaactgccctttctgtgccccgccccctccgggtagaaagcagcacacatttcagagagctcaccatggacgtcacttggctgggaatgcaagataaacgtggaagagctggtgccagctctgaacccacacgcctcagacgcaggctgtacactagccgtgggagagggcagagggcaagcatgtgtcagtgacagccgctctcctagttctgaggatcaagggcacccacatctctacgggtggagaagattgagagtggggccagggtgtagtcctctgagaaaggagtgatacatttacatgtgaaagcagaaggatgaggaattaaggaccccggagctcagtcccagttgagagacaagtgccttctgcatttttccatgctggctcagatgtgacactaaggacagaaagagcccagttcccaagcttcactggagcctctgggcttcttgctatgtcagccaatcacggggatcccaagacggtaaatgttaggacgtggacatgtgagcattaggggctaggccagagccggccactgtttcaacccaaaagatcccaaggatttcaatcaggagcactttgcagaagtaacctgaggcccagagacaaggtaagggggcttcccccggatgcctcgggccctgcggcattcccctactccactctacttccaggaggtgcaaaagaaaaacaggttgaacctaatcctgatttaaacattagtatcacacaaaaatcaaaacgacaccattccaggcaacgaagacaatatcatcaggttttgtagattagcacaaccctctctcatttctggattaaaaattatctcacgctttcagaaagttcactcttacagcaatctacgcactagcatgcgtgacagcaagggcagtgactccggcccagggtgaggtcagatgacacaccgaaagccatgccactgcttgaatctcctgagaatgcagctctgtctcctccaacatgaaaaaggaacaggaggagaataaaagcctcggctgaaagagaggtctgggagggccaccgggaagccacatacatcactgccacttcactaggtgccgcggagagcagctttggagagccgccctggctgatcatgaataatttgccagggaaccgggacagggtggggtggggaaggggtgaggaaggagggttgtgtgtgagaagcccggtcagctccccgggtcagctgcatctggagcggtttctctagcagacagtaaagaactcgattacatccagttaactgtgctctaaactgattatgcatgtgccgggctaatggattacattagcaagaggaaaaataacatgcaatcaatctccatttactacaggccacaccagggcctagagaaaaagtgactctcaaaccacctccaatccccaccccaaatccgtggaatgacgaaaccttgagagggagccttccttagtggcaagagaagtttgatcttagtcgtactgagggaccaaagggctgagggcgagcactggaatgacaatcccagcggtgtcatccaggagtgagcgggagagctccccgccccctgtggcgaagcccgggcaggcacagggccattcattacccaaggactaatgagactagactaatgacctttggctcctgacggaggcaattctgccctgaacctcaggctggtcactccggggatgtgccggccagatgcaccatttcaggatctctccttcaggtgctgggtccacgttctaccctgcatcccaacgctcaggacccttctacccacgccatctttttgagcaacagtttcctctaccttaaaaaaagaaatgagaaaaaagtcccaggatgacaggccagcagtgcagaaacatgcaaataaacctcgtctcttccaaccacacctcaccctgactctctgggtgtgatccgtggacacagtttggggaccaaaacaggatgttctcagcaaatccgccgagttccaggcccgtaagaagcaaagtcaagtgcctgacagactcttattcaagactccagccgcacggaggatgcagcatgagagttaatcgccaccgtgtgcattttagagtctaaagggcaattttttccttggatgcaagaggccagcttcatgccacctctaaacgaccttcatcaaagttgcatgcaaccttcaatggccacgccgagtcctttgtacaaattttactcagttgggtcctttggaaattcttttttccactggtttttccatcaggttttcttgaccacgtcggcaccatcctgtggccagttcagacctccaatttaaactgactgcaaagggcttttttcttttaatggtggcaaaactaagccagtccagcaaggttcttgctcatttgagataaggggattggatgcgtggtgtccagaccttcctcactgcaccatagctgagtccacagtcagttccagaacattctatcccctctacctcattcctgctttctcctcctttccctaaagtgctttcttaagcactacgttatgcaggcctccccacatcctgagaaggaacaactataaaatgaagtacaattatcaaccccggcagaggccgacatgggcaaaggactagaagtcttccttatatggaatctccgtttaaaatcattctgagtagagtagggactcaactagctcggggccagcagaaaccaaacactcgtgggcccaaagacgcgagaaacagtgtgaaaggcaggaggagaggctgataatgggagtgaggaaaatgaaaagagagagcgagggagtggaaggtgtgtgggatcaggccagggagatttatggcgatttgtacctgattgttcatactaaagccattatgggatgattagagaaaaaggtgaggctttaagtccagtgaaaatcaatagagacgtctggagcaattctgccgtgcaagtgaaaggactatttacagtatccggagcacctccccctcggttgccgtctatggagtagagggaagggctggggggaaagcggagggtggagggagagaaagaataaatggacaggaaagagggaagaggagaagagacagaggaagagggggaggatgggagaagcccaggaagaagaagaaaaagtataaggaagagaaagaggacacagaacccaggaagcaacagagcggggaagaaaaaaaaaacacacaaaggaggcccctcatggacccaattttccccacagcatttagcaccttctagcctgctacaaaatttatccatcgtttctcacccatctcctgctaaaagaatggaagctctatgagggcagggattttcttttcttttttttttttttttttggtcagattcatgcactgatgtgaacaaatgcccagaacagtacctgtcattgagaaggtacccagtgtacatatgttggtggaatgatggatggatgaaagaaggaagggaggaacaaaacaccccaggagcatccgggaaaggagaaatagaaaaaaaaaaaaaggaataaagagatggaaaaggagaacagaaagcctaaaggagagagggaaaccacaggagcagaggatgcaaaagagcccatgtaagaaagaaaagaaccaaccctagaggcgctgtcaacaaaacctgacccaaaattgggcacccagaaagagaaccttcagctagtcaagctactcactgaacctgtcacgtttccacctggtgacaaagtggacaccgccgactctcctctcaactccaggttcccaaccaacagccaagcaggccatgccagagactgtccgactcctccccagtgctccctaactccccggtgcgcaaccccctcctttcagaaagagcgcctgagccataaggagctgggccttaccttgtacaacttcaggctggcctcgtgcctggagttgaccgtgtgcagccgcagcttctccaggctgttggtgtagtagtcacaggcgttgcacttgaggtgcacggggttgccgatggccacacacttgagcctccactcgttggccttgccgccctccttgatgtgggccaccagctggtacttctgcacgtgcttgtctgtcttgcagtgcagctggaagttggccttgagctgggtgttgtagcggcagagcttgcactggtatgagtcccccatcaccgccttccactcgtcctccgacaggctgcgctccacgttcatgtgcaggcccagcatgtccaggttgtccgtcgtgaacttgttgcagacggcgcactggaagagcttcagcgacgggtcgttggtctggatgaagctctcgcccaggttcatcagctcctctgacaccagctgcccgcccccgagccgcatgtctagggggatctcaccgcccactgcagggaaggagagaaggagagagtcagacaccaggctcatggtcacggccacagctgaggcaccccccagccctccgccaccctcaactggggtccaaaaggagaagatgacatttcaagtgttgcaaagggctactggctggaaaacaagcaaacaaacaaacacagtcaacctgatgtgtttcaatctttcctgcggacattctgagatttctggcaggttttgtattttctttctttaggaaaagaacacctagaaaagttaggagccatagcctctttaatatttccttttctttttttttttcccgagatggagtcttgccctgttgcccaggctagagtgcagtggcacaatctcagctcacggcaacctctgcctcccgggttcaagcgattctcctgcctcagcctcccaagtagctgggattacaggcacccaccaccacggccagctaatttttgtcttttttagtagagacagggtttcatcatgttggtcaggctggtgttgaactcctgacctcagctgatccaactgcctcggccacccaaagtgctagaatgacaggcatgagccaccgcgcccagccacctctttaatatttcaattcatcccttctctgagatccaagaaaagacagaaatatgtatcattcactggatataacagaatctcaaactgcagaccttccaaaattggaaatgagtcacagctgcaatcgtaacataccaagccttcatggggaaccagaattgggcccagaatgtatctgaggtggcagtgaccaacatgactttctgccaccttgagaacaatctatggctgtgtcatctggtgcagcagtcactggctacctgtgactaataaatacctgaaatatgggtagtgcaactacggaactgaattttcaatgttatttaaatttaggaagctacatggtggtgagtggcgcctgggttggatagtgcatctctaaagcaaagatctggggagtggggctggacgtggtgtctcacacccctaatccaagcactttaggaggccaaggcaggcagatcacctgagcttaggagctcaagaccagtctgagcaacatggtgtacaaaatatacaaaagaaactagccaggcatggtggcgtgtgcctgtagttccagtactcagggactgagatggaaggatggcttgagcctgagaggcagaggctgcagtgagctgagaccatgccactcagctcagccctggtgacagagcaggaccctgtctcaaaaacaaaacaaaacaaaaaaagacttggagagtaatccctctactcctcactgctgccctctggtcaatatccctcccgtcagtcaatgctgccaaccctcccatgtcttctcagtagggctacctgttctctttcctgatcctctgccctgggtgacatgtggggctaccctaggaccaatcaccttccctttatcactcagtcacctacctacagagatgcaccatagctgggatccccatcagggcaccacctccctaggacaggggtccagtcttatcctcgctggccctctacagagtgcacagacgcccaaatgtttgctgtgccagacaagagtgaaaaaagagcgggactgctgcacgttcaggaagtggattgagacaggcagtgagacacgaggctcagctccacgtctccacgaaagggccgggcgaagatctcttcctccctctcccaccctggtctttttcagtccatcactgccctgcataaaccgggtacaagctcacatttgctatggtaaattaatactgcaagggcttatttctaccaggagaatggcttaaaaagagcagccttccctccagttcctagaagcgtacggtcaagcagaaggctgggcactggcgtctagtttctctttcctaaacacacgtgcacttgagctattaggtctgccccaccccccaagtgaaatttaaacttgaccttttatgtgtggttgggctgaggttattttattttttacaactgattagaatccaagtcagtggctcatcagagaaaatatttttttcttttttttatgattttcttattgacgctacacaagtcacctcgagtgataagatcagtacaggttctgctaagcagaccagcagctgcgtttgaagctcacggacagtctagcaagccacagaaatcttttgcacatgcattccagaaggcttaggaagctttcggcttgttgtctgtcttcccatctcccctggtgagaggaaccataactatgtcattctttttaggataagaaagaaaaacagaaaggaaaaagaaaaaaaaaaaagcctaaaagctccatcccttaacggggacgaaggccaggcaacatccaggaaacatactcagtgttcagtcaaagcagaaactgcccggagggtaagacaaggagcaaacatatatttgtttctgatgccaaccacctgaagcatcaaatcgtctccactttttagatttcaccccggcacatcaacatcgctctaaagagaaattcagctgtcacttgctgatgcctgagtgaaaatgagaagtccttggaataagcagaggaacgaagtcccagtttccactttaagctctttttttttcaagagacaaggtctcattctgttgcccaggctggagtgggtcactgcagtctgggccaccaaggctcaagtgaaccacctgcctcagcctcccaagtagctgggactacaggtgcaccccactacgtctggctgatcttaaaacaaaaatgttttgtcgagatgttgcccagactggtctcaaactcccaggttcaagtgatccttggactcccacagtgttgggattacaggcatgagccaccatgcctggccagcattctaggctgttaaaatgaaatgcaaaggacagaagcagcagagtgctgaaatgagtgaggatgacaggcaagtgaaaactcccttcgagaactatgcctcagagaaacaagcccagggcttagaatcctacaaatccgctaatccagctgccacaaagtgggggaatctcacccagttcacaaacaggagcagggcccctataaataagaaactggggctgggcatagtggctcacacctgtcatcccagcactttgggaggccaaggtgggcagatcacctgaggtcaggagttcaagaccagcctggccaatgtggtgaaatcctgtctctactgaacacacaaaaattagctaggcatggtggcgcatgcctgtaatcccagctactcggaaggcagaggcagaagaattgcttgaacccgggaggcaggggctgcagtgagccgagactgcgctattgcactccagcctgggcgacaagagtgaaactccatctcaaaaaaaagaaatgaaaaaaagaacttggcaggtccttagtcttgagccacactggatacgtggtcttggagcaggtccccatctctgggtatgcacctaactctaacactggaactgacaccttgacacgtgagcccacccatcagcacatcctcaggaaggtgcatggattcaaaggcacactctggaatgaaagggagacgaagggagctgctaaaccttgtgcaggtgtccaggggctggctggctacttgggaaacacacagccaccccgacaagcaacccctttcttggtgctatgctaaacttcagagtcgaaaggaaggtttgggaggatgttcacaaggcctcaaatctaatgtgctgtctacaaagagcagcagatccgactgtactaggcgaaggagccccaagcctttcctcaaaggcttctgaaaagaagcaaccccacaatcagtgtctgtttgatgatactaaagagggctctgccaagggaagtatgaaaacaatcaccttgtaaagaggagtgtatttcacaaaaacatttttctccctgcagaactcagtcacatctaataacacctacagccatcttataaatggaccatggggaaaaaaaaccagtacagccacagctagaactgaaagttatggctgtttttatttgcataagttggtttctcctactgaggtcatacaactcaaattccaagtcttttggacacttcctatggcccccacacccactcgagcttctggcataaaggatttgtggctctcacaccttctcagcagttttcgcggcccaaggaaggcacaggtttccagggactccccgtggccgacaagtagtgacactggaaattcaagagccctttgtgactgagctggataaatcctttgggaggaagagctccagtctaagaaatatggtgtggcccttccatgtgtgtctacaacacagggcttcattcttctgctccttctgaatctgccgcaatgcccaggacagtgcatgatgccccaaagactcacagacacttggtgtgaaagcgaaatatttctctacttctcaatacaagccttagttacctgttcttaaggtaattaaaaagcctcactttaggctgggcacagtggctcatgcctgtaatcccagcactttgggaggccaaggcgggcagatcacctgaggtcaagggtttgagaccagcctggccaagatggtgaagccccatctctactaaaaacacaaaattagccaggcatggtggcgggtgcctgtaatcccagctacttgggaggctctggcaggagaatcgcttgaacacaggaggtggatgttgcagtgagccgagacggcaccactcactccagcctgggtgacagagcgagactctgtctcaaaaaaaaaaaaaaaaaaaccctcactttgacccaacatgaacctacccacgttcccacgttctgtcttcattccacctccgttatgtttgatttgctccaagatctacctcccgagattctatgactccttctaattcctactggcttaaagaaaaccttagagtactcactcccatctcctggtgtgcatggttcaccctggtgacaaataagacgaccagtgcttgtgcatccacaattagccagttggtttcaaataccctcaaatcatttggtaataaaggatcaacaggcaaatatttcaaaatggaaaatgagattaaagtactaaggattaaaaactgaatacatagcaagaaaaaccaatggaatgctttgaaatataactcatcggcaacaattagcactcaaacaccacacaaataaacacttgccaactgctgaggcctggccctgcagtcatctaagccatcctggaaaaaaagtcctcactgacactctgttgccaagaacaacctattcccatgtcaataatggcatattgcttaattcaggccattgtcactggtcccacgaagtccattagcagcgtcacgggatgggacgcaggcaggatcctgtttgaagcataccgggtggaggcacgagtggcccaactatcagaaggttctcatgaaacccatctgtagattgttttggcagcagcagctatcctcaaagtggctgtggttcgttctacgtaaaaactcaaagtttttagcacccaaatcctacactcttggtcctattctagatattgtaagccaattggtaagactgggagcctgaacagagccaaatcagcttctctaaagcagaggtcattcttcctggcagcgaaggctccgctaaccaggatctaactgctattaaaagttaactttccttgatggacaatttttacaacttactcatttttcatctctcacacccctcacaacagtgccactggggaatttaattcccaattaatttccaactattctaatcaccaagtactcatcaaaaataagcaaaaaaaaaaacatctctttcattgaggtcctcataaatatacagagaactttgagaagtctatctggatggttccctagctcggcacagaatcagcctttagttatctgaataacgtacactgtggttccgaattcctattattaagatgattgtctctacttaaatcattgaggtaactgtccctagtcctcttattgaaatgattgcctcagctacagtttcctgtaagtttcagtaaatattcgatgaaaccccaaagttttaggtgattatagtgatttttcaaattgaaagaagagacagagaaagagagaatgggaacagaaaactagaggaaacactcacattttaatcctggccccacgtagccagagtacaagcatatctcttttgaatgcataaactcttccatatgtacacacacagttcaagggattcttgagaatacttgattgtaagacactccagtttacacaaaaaccactcgagaagaccagagtcaactgaatccacaggactatctcaccctattcaccattctccctggttaaactcctatcatgaaaacagacaaacacgtagtcatcctcacctagagcaggcgtcatggcggccatgggcccggcgggatccagctggaatccgctcatcatgaactgggcgtccgaggcagcactgtccatcttcaggttgggcaggttcatgttctgggccaggtagtattggtagagctcggcctcggcgggtgagggcaggctgccgaggcccaggtggcggttgtgttggatctgggtcatgttctgttgcagtaacatcatgttatgcatgtgcttctcactggtcatgtgaatgcggaggttcctggccacgttggtctcataatcacacacctcgcaccgccaggtgggtttggtttttggtttggtcggcgagggggccccgcaggagctactgatattggctgccgccgccgccgcagccaccgccgccgccgccgccccggcagtgtggctgaagacctgctccccccctccattctgcaggttctgcatgttgttgagatgcttgtcagactgcatatgaatactgaggttgcctttggtagttgtggagtagttacacacctcgcagcggaaaggcttgtaaccacacgtgtagctctcgcctcgtgccagccgggggtggggctgcccgcttttgcagtagacacaggagccccccggctccgggtgcttctccttcatgtgtgcctccagggtctgctggtacttatagtgccagttgcacttggggcacttgagtgtcttacacgagttacgagaatgcatcatggtcatgtggccgcccagcgagcgggaggagcccaggaccgtgtcgcatttggggcactccacgccactccccgaggggcactccccaaccccaagctcgcagagggagccagcgtgctggtgatggggaacgaagcccccatcgtcaccctctgtgctttcatttggttctggtgctgtggcattgtctttattggcactttcgtcagcgaagtccagcctcctgccgccctctgccacattggccctgacgccctcactgttaaagcttaaacgattcctcctgttcgcaccatcaaagacaacaaaggaagaagcagaattagaactagtagaagctgtgcccctcgacagggtctggagcacgttaggcattaagggggagttagaaatgctttggtttgagagagcaaggtcctttttgctgctactacctgctgcggccccaggctcctcatggggcctgtcctccagttcctcatccaactcgcttggaaagagtcctttgcaaccctcgtcttcctcctcctcttcttcctcctcctcttcttcctcctcctcctccgcctcttcctcctcctcttcctcctccgcctcctcttcggctggctctaccttctcagagaagcaatccccgtcgcccacttcctgcttctctccttctgccgccccagagtccttgccctctgaggatttggtaggactggaagccagaggccccagggggactgaggtaatgggggtcttcagtaccgagctggtgagcccgccaaggttcaacagggtgctgggggtcaagagaccagcctggggctgctcggggccagcggcggagcccgctgggagagcttcctccccttccattcgaatgccactaaatttaccataaaaactgtgtccggggcctatgaggttagctgtggaaactaaagggtgttgaaagtttttgttttttggttccagaaaacttacaaggggttccttgtctttgccgatcccttggatgatagcggagatgttcttattgctaagaattttccgctcgtcttcgctcagggtcattcgatggtcatgcaccgcgtgggtcacaaacgaacggacgtacccaaaggagagtttgcacaagaaacacatcaggatgggcttcctcttgccatagagcacaaagccatcgaatttggacaggtccacattgttgggaacatctttggatacgcaggagcttttggcagaaccgtcgctgttcaggtaatccttgttgcttttgtgtcgcacgtcaaacacgcggaagctgtgcaggacggggctgagccccgccagggctgaggtattcgggaaagcctggtctgggccctcaaaccatttcccgaaggatgaggctatgtggaaagtgttgatgatctgcgggtacacgggtgcagcacacgaagggtccccttgcttgccccccgcgccagggagagagttcaggaaaagcgaggggagaggcccactgccactgccactcccacaggcgcccccgccctgggtcagctggctcaggctctccacaatgtacgcggagccgtccggctggtagacgatctccccggccaggttctccacgtcactctcctcgtccccctcctcaccggtgtcgctggcgctctcctctctcaggggtggcggggggcgcgcgctggggcagtggtgctccatgtaggtctggaggctggcaaaggaggccgaacattcgttgcaggtgacctccttgctggcgggctcggaggggggcccggccgacgcggtgctctccgcgaggcgctcattgaagggggccctcaggctgtccaagggcccgtggctctcgcctgtggactgctccatgctactgggtttgtcagggaggtgggtgctgttgagttcagtccattgctggtgctgagggataccgcacccattgtccttccccgagacgacgggcgagtcacagccttccatggtaaggcctgcgtggagctttcattgcacccagtacggaggctcggacctgaagggcagaggcaaggggggaggagggagagaggggaaagagagagagaaaggaaagaggttaggagggccgaggctgaggtcctaccgcacggagcgctctaagaggcttctgtccacaacacagagacacagggcggagggcgggcctggggacactgccccacacggtccagcacacaggggtggcatggccgggtcaacagcctgagcgagggatatggggaaagaaggccaggaacagccctcttcggcttcgaattgtcaccgctctgcccctgaagactagcgggaatttccattctttgccagcatagcttcgatgggccacagtggagaacggacgcgtcatctctccagccctctacgaggtcacagccacagccctaccacttatggacagctcacacgaagtcagccccgactccgcgcactgtctgtgggtcaggggaacacaggggagggctgagaagagggaggttcaatgtccctggaaaaaggacggtaaagtgggataacgctcatggatttagaacaattgcagccgtcgcttttactgaccatggttctagtttgagaagttcaaagaaggcgggtgaggaccctgaggttcacagggcaggtgtacaggactagacacactccgaaaagtcctctccagatctgggaggcgtcagtcccattttacaagcagtaaaacagaggggcttcaatctaaaaactggctcagtgctaatctcaccaccatgaaacagaagaaaagatgggtccccagattcctgtctcctccacccataccagtcaagctccctggcctgtgactctagctgacttcagactaaaactacgtaggtgcaaaacgtgagcttggtatttccagcaggaatggaccagactctggatctgccaacaccccctccagcagcttctatctggccctggctggagggagtgcgttccccacgtgcctggtggtttttgctatcaaggatctgagcagcaagccgagacggcagctgggctcggcgagccccagctccacacctgcctcttagttattagtcgctacccaaccagctgtcgttcagccctggggcttttccatttccgactccaaagtgccactgagctgaatgtgccctctgagacctcatgtccctggggagggaggcatcggatcacggccgctctgctcctgcagtaatatcatcgcaggggcgatcattccgtctggccctgctcctacaggcagctcagcacctcgcagagccctgatcctttgcccgtaggtccccagccaccattcccctgctgctcctcctggagaacatgtggctgctcctccacccaccatctcattcacactcagccggtgaaggtttcggccaggtttgatctcacttccctccctgacagcccctatcttctcaatcttttttttttttcatttcttgattattgactgcacaatgagacaacagctccccctcgggaaaaactggggaaggcaggtttaccagaagtctcagggagaaataactttttggaagaataaagctatgatgtgtctaatacacacatgcaaacacatacccctatctctccatttataacttcagattttgcaaccacaaagttccatgagccttagaaaggacatactgacttaaaacagagatgactacagtaaaccaaaccaaaccaaaccaaaccaaaccaaaccaaaccaaaccaaacagcaaacgcaatgggacttcctcgcaaggctgagccgggatacaggtgagactgcagggcggctcttcttagggatgcttctgattggctggatgacatctgattgatagcttgggccaaaaaggttggcaggcctgaaggggcgggagggttaacagcccgattgtaaaatcaatgtcataaatgcttggtaagttacaggaacatgcgggaagggggggccacgattgataaagcagaacagctttgatgctgcaccagggacttgtttatcgacagcaaagccaatctcctctccagcctgggctgggccagagaaacctgcaagcgtttaccaattaattggtgggcttctcttgctccgttctcctcttattcctcctcctcttccacaaactatccagccaagaggctgggacttttaaaacctcccttactttgttttctactccaaagcggaagatgtcaggaaagaatgacactgtacccacctatgatggtggctggtgaccctgtggtggtgacactagagcccacccattcacggggagcagcagccatgaggacacgggtcggagaggaggaacccactgcaggacccaagctacctcccctgggcctcctttccatgcgcaccagctgtgacaaacaggcccgtttgcagccttgccaaacaagcgtggtttgtggacttgaagcattatcctctccggggagcttaagagacatgcactgtctcctcctgccccatcagaatctgcattttcacaccatcctcagggaccatgcattaaacttaagacactctctgcttcactccatcttcaccaatacaggtaccaagcacagctcttctgtccttggtacctgtattgctaggtaaccagggaaggtcagtcttagattccctgtggtccctgggaggtgcagggatggagatggagaagagggggacgcgcgcacagaggtaaagaagtctccccaatccgccacatcctgtggctcaagggtctcagggcatctaccactcccccgcaacagccggctctctctcgctctgtttatcagccagtcaataagaaaaaggtagttcttacttaaggaggcagaagtcaactcggcaggtcgatcagcactctgtctgtaaacacggtttcccgtaaaatcaatgatcttcagttacagagggcagcctgggaacccagtgggtccccgcacttttccaagcagccctgccagcctgacacgcacacctctcttcaggctccctccacgttctgtgccccttcccagtacttccctagtgccagggctagctggtacaggttcacacccctcctcccttcctgcagcccgcttctctgctggtggcacccggaactccctctaaaaaatgtccaggtattctgctcacaacccccaatgttgcactcaacatatgggcttcaagaattcagttagattttaatagagcacatctctccagtgagaaagttaaagggaagataggaatgacctagctggctcactgtctgcttagcacttaaatctgccatctgaaaggtaatcttgtacagaagaattccagcaccttcatcaagtatcccccaactcctgctcatcttccaagctcccttggaaccacctgtaaagcccactgcatctttgcaaatgtcaatctttacttttcaaagattgtttaaaaggataaaactctaccctgttaccctgtatctccctattaatcaaaacgttcatctccctctttaaaaacatgtgctgatgacagttttatcctgttcccttgaggcagaactgggtaaaatgcaacagtttcagggaagctggggtgggaggggtgcagttatgacgaaggggagggggctcctgctgttgctccagctcccggagaatgaaacatgaacagtcgcactgtgtaattttaaattgttaattagcacagggttaattaggcagtcctttcacaagaggctgtctggtaggaaaccaagaagggaaacaaaggggaagggaggaaaaacaaagagagaatagaggcagtgagaaactgttgcctccaagaatatcccatgcgggatcactcaagagacatcagccagcaggcaaggatgcctgattccctgggtgatcccctgctctgccggagggagaagcagtgaataccgccttcctacaggcgaccaggcagcatacatcaaaggcctcagaagtgcacatccctccccgttgactcaacaattccccgttctaggaattcatcataaggaaagaacccaagcaatgcatggagatttaagtttattcatgaaaaacataacaggaaaaaagaggaaaaatttgggcaaaaacagaccctaaataaattacagtgcacagagctccatatgttgttataaagatgctttcttcaaagaaactatttataagcatgggaaaatgatcatacagatgctaaatgaacacagcacatataggtattatggagaggaaaacaggagagacttatattacaatttttacaactgtgaattctagggaatgaggtataggtgacttcatttcctcctatgtgcctttatttcccaaagctctttaaaattaaaaccatcattgagacagtaggattgctagagcccaggagttcaaggctgcagtgagctacgatcgggccactgcattccagcctgggtgacaaaatgagacttggtctatttaaaaaaaaaaaaaaaggaaaaaaattgaaaaccatcatactggaagtcatcacttaatgagttaggtgttgtgttaagacccatgggtacagcatcactttgatcctcatacccacactaggagatagatactatttttatccccattttagaaatgggaaaactgaggtggcccagttatgcagcctgactgacaaaccggagagtatgggtgtggagtctatgctttcaggcagttttcctttgtcacccaggctggagtgcagtggtgcgatctcagctcactgcaacctctgcctcttgggctcaagcgattctcctgcctcaccctcctgagtagctgggcctacaggcgaccaccaccacgtctggctaactttttgtagttttagtatagatggggtttcaccatgttggccaggctggtctcaaactcctgagctcaggcaatctgcccgcctcggcctcccaaagtgctgggattacaggcgtgagccaccgcacctggcctgtttttctttaatgtctaattttcaaaagagaacactagaacatccctacatctcacattcacactcagtctttaagcacccagggactgtcctaaggtgatgggatcccaggactgctcatgcaaaagaacgctggcatctcacccaaacgcccttttcttgcttgagagtgatgggggtgaggggaacagttcaaagcagactgatttgcttggatatctttaggcagacaagagaggataaaggaggtaggagaagctgctgcaaagaactgaaatgtaggtccaatatcctgatttttaaagaaggacaaaaggcaggttccagaacctacagatcaggaaacatattcattcgttcagcatttactgagcatgtactatgtgtcagtcagatgctacagaatccatgctaaaaggtctcggcttacattcttgtagagaagagagaccacacacaaatacactcaaataaaaagcaatataaagtaatataaaacaagagaaggggaaagagtgatgtgtgtgcatcgttttggagaaagtcacaatgtcagagtgacttaatggatatggaaatacttcaagaatatgttgtaaagcatatactgtaagttcttcatagttttcaaacagattcaagttgctggaaaagaattttaggggtgggatgatcctgaggaattagcgattagctgtaggtccagtaagaaaacccacataaaataaaccgaaaaatacccttacttagacttaatgatctgagaaatacaataaagtctgcttttttatcttaataaggtagcacaaaatttatcatttctttatatccaggatggcaaaatggctttcagataataaactgtggccaattttatagccgactaatgatgccattattttaagcgtcaacacagaggtccgtgtgtctcgggacacgccaacaaggctctgtcttgtccctatttggctgactgaaatcaacagcttgaggaacaagaccatgcaggcatgtccacttgcagagcacaccagactcgagggaacaattaaaatgctcaacggtggaatcaagactgaggaaaaaaatctccatgagttggaacaacaggcccaaactaacagaacaaaactttagatggaaaaacatgaagccctacatttaacttcaggcaatctgctaaaccaatagaggatggaagagacttggagtcataagagttcatgcaaacaacaataacaaaatatctaggagttttacttgatgacaaactcagaggaagcccgaagttggcatggtggccaaagaccataatggggcctttggcaacagtactactctgtacctgttggagctcagcaggtccacagcccatcactttctctgtctgcgtgaataatgttaggaaccactccagggaatctcctaagagagataccaacaaagaagctgtagcctcatcggaatggctgaacacacacaccattcacgggtgcagggaagagaagtcccgttgcagggcaaggcagctatcctcggctatatgaaaccctgcctgccacaggcaagtgggtttggttctatgggttccacctagttccagggttgaattaggggcaatgaggggaatctataaggaaagagaggtggggtcactataaatgaaaatctttctcaagattatcacagttcccaaatggaatgtttatgctgtgaaatactgcactctgtggcttcaagaatggagaaggggattgtgctatggccagggggctgtatcaggcagcctatgaaaggtgaagattcttctcattcctgggtgttatctatgggcttgtctgtccccaccacaaggctatgagtggcatgagatcaggttccctgtgctattcatctctgagtcctccacatctgacatgtaataggtgcttaataaaacaatgggggaaataggaaaaaagaggatccctgaatccattccttttctttttttctcttagtttaagacgtgtctggtgtaaccattctccacaaaatggaactggggctccttggagacatggccaattcttgggctggagcaggaaaagttcaagatgagctcggagcatctacttgtgctcaaagaataaggaagatgtgtcaaaatgacctaggagtgggttggaggggctcccagtggccacatcagggacaacgtgagcaagaaaattaagtgacagtaagtgattgcaacccaatgtgtaacataacaatccccaagtccctactttaagaaaaaaaaaagtgtgggagaaaggaaagttcttccacagggtagaaactcaactaataaacgtagaaaaagagtatggagttagaaaatcaccatttgataaccatcatcatcttcatcatcatccactcagggaagaatcaatgggtacccaaactaatggatgaaagtttgaatacttccgggagcggtggctcacgcctgtaatcccagcactttgggaggccgaggcgggcagatcacgaggccaggtaatcgagaccatcctggctaacacggtgaaaccccgtctctactaaaaatacaaaaaaaaaaaaaaaaaattagccgggcgtggtggcgggcgcctgtagtcccagctactcaggaggctgaggcaggagaatggcgtgaacccgggagacacaacttgcagtgagccgagatcgtgccactgcactctatcctgggtgacagagagagaccccatctaaaaaaaaaaaaaaaagtttgaatactaacaggatatttacaatctcaaagtctctccccacaggatacttcttaattatagcaggaaaaaaaaaaacaacaacaataacttcactgtggagaacctggcagacaccaccttcattgagtgatcaaagttcccatcaccagcagtggggcaaacagacgtcatgtgcctcctggtaggatacaccgagaggaacacaacatcccttccctggtgttcctgtcaaaaacgcacaaccggaatctaatcatgagggaacatcaggcaaatccaactgaggacagtctgcagaatgtcctatgctttttagaaatgtcagggccatgcaacggaaagacagactgaagaactgtttcagattaaaagagactaaggagacatgactaatgaacgttatgcataatctgggatcttcttttcctctaaaggacataactgggacaactgacaaaatctgaataaggttttgtagatgggctaatagtggcatatgaatgttaatttccttttttttttttttttttgagacagagtctcgctctgtcgtccaggctggagtgcagtggcgcagtctcagctcactacaacctctgtcgcccaggttcaagcaattcttctgcctcagcctcctaagtagctggaactacagatgcccaccaccacgcctggctaattttttcatatttttaatagagacagggtttcaccacactggccaggctagtttcgaactcctgacctccagtgatccgcccacctcagcctgtcaaagtgctgagattacaggcatgagccactgtgcccagcctcatttcctaattctgataactgcagtgtggttataaaagagaatgtctttgttttttaaaatacacactggtatatttagaggtgaaggggcacaatgcctcgattttcaaatgggttaggaaaaaatatgtgagtgtgtaagtgtgtgtatgtgtatcagtatatacatacatacacatacacatatatacacacatatatatgtacctacatatatacagcaggaataaatatatgagatgttaccataggaggagtctagaaggaggacacgagaattctttgttctactgttaaaacttccctgtacacttgaaattgttaaaagaaaaagaaactgtccagagtaaaaattcgacatagtaaccccccaaaactataaacgaagagtcaacccaccctgacatgcgtatctttaatctttatgtgaaatttgctcccagcagagcttcaaaaaaggaagtggctgtgaggctggacagagaggtgtagagagacaaaaactgaaaactggtctccccttcctccagccaagaggcttctaggtggagccttccagttggagaagacaaataaatggccattccaacttgggcagaacttcacgtaatacaatactgagccgtttccccgtgacactcatgatcctgactgtgggctgatttccctagttccctagggaactttcgcaaagttccctaactttgtgaaaagtgattctaagtaaaaggacgagggcagcccccagagaaaaggagaactccagcagcccccagagtgtgagcattgttaaatccaggctaaaacatatcagagagaaaaacacactacactgaagcaactatcccctcactaaccccacctccttaaaaaaacaaaaacagaaaaacaaaggcaacccagattccaagagaaggtgaaacctccttcaagggtcaaagaaataatacctgcatctgtttagcttggaatccactgaagaaccatacccagttcccttctgtgtttttttacaataacagtgtttgtctactgctgctgcacagaagtcaatatgtgttaagccatacataggtgattccatctgcttggtagcaatttcccagcagccttcaggattgctctgcaagtgtggccaggtcggagaacacacaggtgcttgaacaggcgccttgtgctgccggacgcccactgcccagaaggcccagagaatcgcccaggccgtgggcctccatgtttgctaataagtgcatctgtgctatttccagcatgaacataaatcagcctagaagtgaaaactgctagctcagcccattctgcagggaatccacaaccaccatgatattctggttacagtggagtcgtggagggcaacaggagagagtcgtgacagcggaggcaggtctaggaacccagtctgtgtgtacttagaggaattaaaaaagattttttttttttttactatatatgtaaacatactcagagttcaaccaccatgaatcaaaaccaaacccatgaatataataataaaaagcaagacaaaccagctattatttatgctctgccttgttctaaaaagggatttggggcaatttaaacagctatagtaactgtatctcacacttgagtacgtaagtctctaccctgagtcacgtggaggcctttccaccatttccacaacaagaaagacaagcatcgtgtgcccatgactggcttgactggtgctcctgacttggatttaattaccatagagcacggatcccctcccggatttgcagcagaacctcctttcaccaaataccattgctttacctgactgtaccaacccacctctcctaccttgcaagcccgcagctcacaaccccaaccttcacccatcttctggcactttcccggctaaaccggacaccttctgacactaaccataaccaacacttatgtgtttcctttgccagcactcaaggctttttcatctcctcccaatttcctcaaagtccctctccaagatcctatttctactctctctccactcttgctattgggattatagggcaaaagctaggagacaatgtaaaaacgtgccatctggcccattacagtttcaatctggcatgtcatgatgtcaaatttatgttaaatcatgtcttatgattaaagttgtgggagttcattattttaaaaatttggatatgtacaaaaagactcagcagctaaagttaaaatcactgacaattccaccagctagagaaccactggtaggtagtttttcgggcttttttcctctgcacgtttacagatacagattttccttacctacctcggatcacgctgctgtttatgtaggccgcccttttaacctaatttagtatgaaatttttcctatgccattcaatattcttcataagttaaaactaatggctatatagatactatatcttatacacattgcataatttccaccaaatgctattattagacatttaaacaattcccaatattttgctgttcattttgcaataagggcccttaaatctttgtacacatataacaacaacaacaaaaacaacaaaccaagtagtagctccattactgtccacctggttgaatcaagcatggttttgagcactatttttctgaacatgttgttttgtttgatccttgcggcagcccactttacaggtgaggaaactgaggcttagagagttaagtaccttgcccaagctgcatgctagtttagtcggcctttgaaagtaggtaagcctcccttaccactctaaaactaggctcttactcatgacgttgtgtctgtattgccttaggatgcatttctggaagtagagttgctgactcaaatgctaggaacatttaaggccctctggaacgtgccaaactgtcccccaggaaagtcctttccactcctgcttgcactggtgtgtgagcaccagttttcctgcaccctcatcaacagtgggtatttactttgttatttttaaaagtccgtttgacaggcaagaaatggcatctcattttaactcacattctttactcataagacagaacccatctatggatatttactggcagtctacatttcttttgtgaactgcctattaatttttttttttttttttttttttttgagacggagtttcaccctgctgcccaggttggagtacaatggggcgatctcagctcactgcaacctccacctcctgcattcaagcgattctcctgcctcagcctcccaagcaactgggattacaggtgcaggtgtgcaccatcacggccggctaattttttgtagttttagtagagtcagggtttcaccatgttggccaggctggtcttgaactcctgacctcaggtgatccacccacctcggccacctaaagtgctgggattacaggtgtgagcattcatgcccggccttgcctgttatttctatggcaggtgtgtgttgtccttttctgagtgagtaatgaaagggttttgcagaatttgactggtgatccctcccccttgagttcctaccagtccaccatcctataagctcctggacaggagagagtctgacctacttacactgccagttcagaagatgttctctgtccttcagatctcaactccatccaaagagtggactctgtccactgcttcatttgctccacatcaattttcctgtattcaagtgaagtccccctcctttatgtgattataaagggccaaactgcatcaatcattttcaagctttcttgtgcagtggaaccaactatgcggcacaataaaaatacatatggatgtcaagccccagcccagagcacaagactagctctctgaagggctgggtatctgctccgggagggtgggaaggcactatgtcgccaagatttctgtcctctgtccaaagtcatcggtgtcctcctggtcttggtcaatggttcctcctcctctactttaagcttcaatctcccctgcattcaaaactgcttccccctctactccttgaaatcttcccccacttcacttctgacatattctggccctcctcccacctctgtcatctctacattgcctgtcctctccccattcctacagctctccatgggtacattttccacttattcgataaaattcttttatcatttcaactcacagacatctctcctccctgttctcctgtaggtatttaagcgtcattgtactcttcccccttggctctctgctcttaactctgtacatcagctaccttaactacttctgcggtttcaattactgaaattacgagctgactcccaaagcaaaaatgtccattcctgacttggcacttgaatatgtgtctcatactttcagaagaccagaagatgtctgtacatgcctagtgtcccaccaaccaagactcagcatggctcaacatgtccaaaggacactgccccctcactgtcggccctggtctctctggaaggaacttttggtgccatctttgcagaaaacagaaaggaaagatcagtctggctttcccaatatcatgttcatccccatccttccccatccaagaaacaactaccaaaacacattcaaactgaaactctccagagcggtttcaaatcaccccaagatctaccactaacactaccattcaatcacctgtgtcgtttccctccaactaggattcctccccatcatctctgcattctgatgcattatcaactctgttcccacaaccccaggccctttgaatagcctttctcttcctcaacactcatccaaacctgggatatccttaaagaagcacaagctcaagttgtacttggccaataaaatcctcgcctattggccaggcatggtggctcacacttgtaatcccagcactttgggaggccaaggcgggtggatcatctgaagtcaggagttcaagactagcctggccaacatggagaaacccactaaaaatacaaaaattagccaggcgtagtggtgggcgcctgtaatcccagttacttggggagctgaggcatgagaattgctggaacctgggaggtggaggttgcagtaagcagagatcgaaatcactgcactccagcctgggcgacagagtaagactttgtctccaaaaaaaaactctactcggaaggagaaaaaatcaggtatgaactacatgcaagtgaacccctgggttcccgcttcctgggaagggctatcaaagccgggttcactagtttaatagaaagatgagtctactatggttcctaagttcctattaggtagctcttagtcagcagaacactaattggaacagaagtaagtgctatcattcaaggctgcacaaacccaagagaaatgaacttggtcagattctttgcacttggcagtttggggaatgcaggcagaagcagccaggagccttaagttttcttttattcacatcgaatctacctgagaacaaatgaagaacatggtacagctgcttttctctgggcctgtggcagctaattagagcacctgggaaacaccattcaacgttgctggacagaggtacgtcctcgcaatgattccgccaaatggcacacacaggacaatggggaaaacctgtaagggtgaggtgagagctggccttgggcgaaggaaagtttcccacagcagttatctccaaaatgactctgaaacaaggagtgtgttttcctctcggcaggaagaaaaccactcggtgggctcaccatcggcagcttgctctggcacgaggctccggaactggcaccatgacaaaacaaacaaggattgccctttggaggctcactgatagggcaacacacacacacacacacacacacacacacacacagcctctcaccaacacgggcacagcgagttcttcagatatccctggcctgctggcataaagagcttttcaagcagtgggaagccaaagggacactcaacaaagcagtaatggccactgtaaggtagagacattggtaaaggcatgaaaaggggatgcctactgcaaaagcaaaatcgtacacggggtcttccccatgccttgactgggcaccctcgagagacccctttgggatgtgcgtactaagcttccacccaacttcctatctggtggaggcatgctatgcacagagaccccatcactgaattccctcctagataactcactgcactagactgaaggcttgagaggtttatttcatcatgagtagtcctcaaatcctagaggcccagagagttgctcctatctcgattctctttcttagggtaaagtgaaccggcagcaagaactaccaccaggacgcaagggctttgagacagactgaagggggcatggattctgctggcactctgagtttgtttgaaagacttccaaattccaaagcttaaaaccctatcagggccaggtgtggtggctcatacctgtaatcccagcactttgggaggccgaggtgggcggatcactggaggtcaggagttcaagacaagcctggccaacatagtgaaacaccctctatactaaaaatacaaaacttagccgggcatggtggcaggcgcctgtgatcccagctaactcaggaggctgaggcagcagaatcacttgaacccgggaggcagaagttgcagtgagctgatcgtgccactgcactccagtctggaagacagagtgagactctgtctcaaacaaaataaaatacaatacaatcaggagagaggggtgtacagggggaagagaggggatcatgaaacgtgatcacatgtccccttcttcatggccccttctccatcccacatggtaattacaaagcccattatttgcactgttacttttaatcaagaaatccatattgagacatacttaccactggccacttcaaagagcggccctgatagttagctaaaataacaaaggaaaatttcttcttgaagtgtaaggatccaagagctcacacttccttaaccttccagaagccacccagagaaccaagtgactgtgggcaataattacaccctcaccaactcagcaaaaatggcacagatggtctttctcctcttgctgctcccaatgctgcgtttgggtcaacagctgctaagaagaaccaccaaggccacgttaaatagtacttggattaattatgcttgaaaatctcttatctgagcactgctaagacagaacaattgagtttgggaatgagtgtggttacatatttttccttaatggcttcctgaacaccctggttaggtctggtcccaggggagaaattgccagctcaagtcataaaatgtgatcaatgtagatcaagaccctgtgctaagtgtctaggatgaaagaggggaagcgtatttgtgcaaacacacaaacatatgaaaaatgcatgttaacataaagaacttcagctttctttctgaagctgcaccctctctcctttcatgcctagagctctgctcattccaccaaaacttccagccagcagttctaatcttggacagcgccagaacaaattttggcaactgttcctgcagttccaaaagattcccatgttaagccatggtaagattcggggaatcaaatctggatggtgaatggggccaatttctttgacttcaataacacagaggctactggggttccagccccagtggtcatagttttaagctcctctgcataatacttatccaactactcactggttgttctaatgatttttattcattcgtgccacaatatttattgagtgcctacaacatacacagcgcgtccctcctgtcgatacagactcctacgagcttgctctcagtagcgtccaggcaggcaaaggaaggaactggaaggcagtgatcaggaccccggtagaaatggactcagcactccacgtggccactgggattcactatgtcaacacaattatctgggttactgctcgcctcattccagagtctacctgctctgatgccagaatctgtccttctattaacaaggtgtggtcacagtgaactgactgaggtccactgtgtttaaaaacactgaccatggcatctcatggctggacaagtggcaccgccgccctgagaccctgcagtgctggggaacccggaggccctgagacctcggttcaactccgccagtgccccgggagttctaacccccacgggggtctcgccttcagtccacatgggagtcacccatcaaaggcattttagggatattttaggttgaccatttcctgacagcccaacatgtttttctctgggatgaagggcatgccatcccacaaatggtgatgagaaattgcagaaccactgaaccggcctacacataagcatttcttctcctttgatgtcgagttgacaagaaaggatatgatttcatttctactggctcctcttaggtaacccaactggtttcccacttcctcacctgccctttgcattcccatcctggtttctttggccttggttcctctttaagctgggaccagcgactttataaactccacacacagtgcagcaggttccagacgcagcgtctggcctccccaggtcttatgaagaggtgctgagggttggcgggttgacacactcactgcactgcacaaggaggtggctcagcccagctttcacgtgaccagtgtccatttatagggtcgcatgctcacgacacatgctgcattatggggaatgctgcagagaggggagtcttattcttaaaggagttagaattgaagcataaagtctaggaactaacatgaaccacctcttagaagtctatgtacaacctgcactcgactttgagttgttccccaactattagttccctgtcgtgggtcagtggggggaaaaaaatcactctccacacagctcttgaggagaggctgggatctctacgattcacttggtgtctacctgcaggggactcagggaaaaaaaaagcaaaagccacaccagcatgagcatatcacacagaaattctactgaccccaaaagcggggcaatgaaaatctgtgcacaatttcaaaccatgcaccccagggtggaggggagagatggaattcaggggaagtgagaagaaaaaggggaagaagaaaaggaccagggattttttttcttttttcttttttttttgagacagagtctcactcttgttgcccaggctggagtgcagtggcacgatctcggctcactgcaacctccgcctcccaggttcaagcaactctcctgcctcagcctcctgagtagctgggaccacaggcgcacaccaccatgcccagctaatttttgtatttttagtagaaacggggtttcaccatgttggccaggatggtctcaaactcctgacctcaggtgacctgcccgcctcatcctcccagagtgctgggattacaggcgtgagccaccgcacccagcctgggattttttttctttctaaggaactctttcccgagcattcacgacccagccctttctgctctgggatggaaagtgttactcagctacaaggcctcttgttaattgtgggtttttatttttatttcctattaccctctcacacgcctgatgagattattttaccggaactgacacagctggaagcagcaggcatacgtggagcctctgaggaggtgatgcaatttcattttcattgatcagaaatcagcagggcagtaagtgatgggaaattccattagaagaaaacttgcaggccataagcctcaacttcccagccacacccaggaccccttcccccactccctgaccgaggtctcgccttcctctgggctaagtccacactgcccagaggattggaagtgctctcctcccagaaaaataaaagaccagcgccacgctgctggcctaggagagcatcggccgggggtgggagacatcgttggactctgaaccaacaaggcacctcggtgcttctctatggattacagcaaagtcttccagggatgcagaataaacatccttacaaccaatctccacagccccttgggatccccttccaaatgtcaacaaacaagaaaaggggaggccactatacaacagttgtaaagatgtcctccagccagtcatagagatgatcctgaaggcacttaccatttattgagtgcctactatgtgccaggcactgtgctaggtgcttaccatgcccagactctggtcctcacctaaccctctaggacagatgttcttctccctctctctcctggatagatgaagaggcagaggtctaggaaggtaaaggagagaaccagttggtaccaacaccttcctgagggtcaggccaaactctcacaagcagcaaaggaaagctgagtgtcaacaggagagctcacacctgagtcctaagagagcgtggagcacatgtgatgggctactttactcttttacagatgtagcagatgatagattgtgactaatccacctccatcatcctcagcacccaacaacagcgctcctgtgtccaaggctggaaccacaggtgggcttctcttcggaatacgcagaatggttactgttttagcagttaagatccctccaactgtttgcctgccaaatattgctttgcttacctaaggcctatggaaaaaacagcaaggagctcctcaaaaagacaagttctatgaaaaacaccaccagccaggtggctctccagacctccacaggccatttcgccataggaaagatggatcacagaagaaccagggcacagtccgaaattaacactgctccccacaactcttcactgttaaaatggaaattttacatggaccagtgatggcaatgtgtccaaccaaaatctctcaggaagcttttattgagtacctaatctgtgcctcaacaaagcaaagaatatataagacatggaccccgaaatcaatgcgcttacagactaggtgatggccccataagaatacctagcacacagttatttattgatcctgtttacaatatacaatacaacatcatagcataaattgaggcccgggcaaaagaagaaagaaaaaacaaaactggaggaaattttgaaccaaaaaaatcaagcttaaaatgcatgtaagaataacctacacactgagtcaaatttggctctaagctttctaaaagtcaagaggataaaggcatgctaggtatgcttttaaaggtacactatttacaatgtccaagagaaaaaaaaatcaattggtcaggattatttagctccagtaatttctcaactgctgagaatgggataagactaggtgcaagtagggcgtgcagccctatttcccggatctctttgtggaggtaataatgagaaggcttgagtgtgaggccagctagtctcactgtttccactgatagacaagaatactgaccccacagggtgttggtggtttgctgacgtcagagagccggtcagtggcagagctaggacgaagacctgggtatcttcacaccacactaacagtgccttcctcccacatgaagctactccgcatcatccttttaaatccacaggctggctggatgggtaggggctcacatggacgttggggaaggaggagaactgttctagattaaaggggacctaagaaccaaacaacagctagatgcgctatgtagtttcgtatggatgccagttctaaccagccaaatgtaaaaagccattttggggacaatcagataagtctgaattgcaacttgggattagatcatgttaataatgtcagttttggccaggggcagtggctcaaacctcaagtatcagcactttgggaggctgagacgggcagattgcttgagcccaggagtctgagaccagcccgggcaacaaggtgaaaccccatcactaccaaaagttaaaaaaaaaaaaacaaaaacagctgggtgcagtggtgtgcgcctgtagtcccagctacttgattgcttgagaccagggaggtcaaggctgcaatgagctgtgatcgcaccactgtactctagcttgggccacagagtgagaccttgtctcaaaaaaagtcagttttgttagggaataatattatgtttacataagaaaatgatgaagcagcatgatatcgttggcttcaaaatatttcagcaacggacaaaaaagacggaacaaatctagccaaaagttcattgttaagtcaaggtgatagaactatggaagggttcattatatcattctttctacttttatacagtaattttttttttccttaaaagttaccattcgctatcaggaacatcttctaaaagaacagcattgaccagaaccaagagattcagtcttgagtcaatacgttcatggcaagccaagccttttttcaaagaaatgtgggtttctcctttcttccgaagggctttcctcccaggccgggccccagctatctctaaagctcctttcaaacaccaccatctactgacccccactcttactccttctcttagaaggtaccaagcaccaccaggctgctaatgtttaaaagaacacagaaaaagacaatatgcatcacgcctgggcatagcacctgacagcctttataagtggtagctatcacgatcattactgagcaaaaatgcgcctgtttacaaaagttaacagcctaaggttatataacagcttgatttcaagctttgagccaaagtctgattaagaagaatatacatccgttgaattaaaagcctccacttcttgactcaacgggttaagaaaatatttttaacactttcagtgagtttaaaaaatcagatgtttaccagccattgtttttgcgcacactgtcttttatctcagcatgaatgttttataagcaccttaattgctttgcaaagcctcaactgaactgctcccaattgggctggttctctagtgtggctctgtaggtaaacggcccagtggtaagtgggcttctggccatatgtgggcccatacccacccccaacatccagcacaccctccaacttcaatacgcatcaccatgctgcaagctccccagaagcactctgtgcaatggacttcttcacggggaccccaatatgtgaccaagggcacagtcacacccagcaccagccttccaaagggcacataacaatgcttcttccatgcacacagcgttttacacattttccttttttttttttttttttttcctgagatggagtctcgctctgtcatccaggctggaatgcagtggcgccatctcggctcactgcaacctccacctcccgggttcaagcgattctcctgcttcagcctcctgagtagctgggattacacgcacctaccaccatgcccggctaatttctgtatttttagtagagacagggtttcaccatgttggccaggctggtcttgaactcctgacctcaggtgatctgcccgccttggcctcccaaagcgctgtgattacaggagtgagccacagcgcccagcctttctacacattttcaaacactctcatttgacctctaacaatctttttaaatagaatgggaatcatattttcgattttacaggtttaaaaaaataattcattcaaacatctgagtgactcctacgagtcattctttctcaaggtcctgcaactggttagctgcagagcaaggaccaggacacaagctacagtttctactgtggtgctcttggctccatgaaggcatcatttccttaaagagaatcaccaactcacagagaaacaagaagaataaagacagaaacctacctgctgcatgcctaagcttccaaatccttccaaaacatgtatcatctaaatacgagaaaaagataggatgccaaagacccaaaggaggtattttcattgatcacacctcagtggagtagagttatacacaccaccaaatattgagttgctccacacagaccagaacagtgatggcaagacattaagtcgtaaatttttacataggccagaatggtggagggcccgagaaacaaatccactaaagcaccaagtgctgaagcaaggatctttggcccataaaaaagtttaagatctgaggagtagcctgggtgcaactcctcctcttagaccctagactgcaaagacaacactgtcatccaaagcagactgaccactcggctcaaaaggctatttgtaaaaagatgtaataagctgtcaacgtccaggagctcctcatgaaggaggctgaactcagaggagctcatgtcaacgcagagttcaggttaggaccagtgggggtaacgtaaagggtgatttgggccccaggattactgtagcatgacccaagcaaagtgcacatatctatgtaaaacagaaaagaaggaaaccggcttcttccccgtcaggaatgtcgcttattctatgggtgtgagcagtttctttagtccactttctgccatcacggtggagcccttggaagcccctgttcctaccgtgatagaaaacaatgagacttatgaggcaacttaataaccactgaccaccttcttagtccaactgactaagctgagtgacatttttaggaagagcattaatgcggaaaacaaacctttccaattcatggaatgaggtaatctgggcagaggaagggtgggggcagagtgagtagatccagaacacaaaacaatgaccaggatccccgaacatcccagctggaatgagggcaaccccaaaggggtcgacagagaaggcctaggccaggtgcgatggctcatgtctgtaatcctagcattttgggaggccgaggcgggaggatcacttgagcctggcagttcgaggccagccacagcaacatagtaagacccccatctctacaaaaattaaaaaattagctgggagtggtggcacccacctgtagtcccagctactcaggaggatgagatagaaggatcgcttgagcccaggagttcgaggctgcagtgagctatgaacgtgcccctgcactccagcctgggtgacagatcaagatcttgtctcagaaaaaaaaaaagagagagagagagaaaggctgcttaagccattgctccatgcaactctccaaccacatgtcaaacaccattcctaccatctgtccttggagcccttccctcaccagcacaggtctaactacccactgccaagtgtgggtacagggtaaggccctgctcagtaagcctgtggtctgatactaaagtcatatcttgccattaccccccggccccaccagttatagtccagaaccttccatcttgctgttggctctctatggcctggcttcctgaccctgttttgcatgaacccttgaccagctggggcttaaatcccatgggtgggaatctcatacacctgcagccttcttgcctatacctgctcacgctccttcaagcacaggcctcagcccttatctgaataacctgtctgctggcttcctccccatctgatagtttcactcctggctcctctcaggcagcaaagaggaataagcaagccacaggctgcagcctggcaagacagtcaggaaggtggcagctgccctgattcaaccttcctcctagtctatctactgcctcttcctcctccattccccagtgactccatgaaacttgtgttcacaaacttgaaaaattcactggtgaggccaggtgcagtggctcatgcctataatcccagtactctgggaggctgaggtgggaggatcacttgagcccagaagtttgagaccagcctgggcaacacagtgcgacctcgtctctataaatccttaaaaattagccagacatggtggtgcacgcctgtgaatccagctacttgggaggctgaggtgtgaagatcacttgagctcaagaggttgaggctgcaaggagccacgatcacaccactccactcctgcctgggccaaagagcaagactctgactcaaaaaaaaaaaaaaaaattcactgaggagatgtggtagatggcttagaggtcaatgttataggtcaatgtcccttaggttgaacagcacctgtgttgctgggtctgcaatgttgaggaccccgtgatggtcttcaataaggctggggcgaaggggctaaacctcactatcgtgtgcaagctcaccccaggcctcaacagaatttatacatataaaatttatatgcattacatgtttacatatgtatgtatacatgtacatgtatatagtatacatatggatatatttatataaatatgcatatatacctatacacatatacacatacatctctcatatttaaaacaaaatagagcaattaaaagaggaaaaaaacaaagccaacacacacgtacccctaccaccaccactacgaacaccaacacgcccccacaggcaagatcttgtcccaagtttctgagaaacgtcacttaatactacgtaatctcgaaatgatggggtctgcctactggctttgtctggagactggactccagctgctctcctaaactgtccttgtcaccttctcatcaggagaaaaggggaacgtaaacatgaaccacaccagagatgggctatccagtgaggctgatatcatctcaggcgccaccgacatctctctccagcattctgtcatcttatgatcaactatgtaactccagacatccaggggaacctgaatcctagaactagatgtccccaaataagtggtttctctgtaaaagtcaaatgtggatcacaaaacaaatgtgaggggagtcccaggaaagccagttgcataagggtgtcctcaattaaattctacacacgtcaatttttccccagggagggcgaggcagagctgagaacaacattggactggacagactcaaggcagggaagaaatggaattttcgctcttgagattcaaattcctgagtcatagttgaaatcccactgctataattgttttaatacactgtctccacacacacaaaaagacgcctttaaaaagttgtactggcttccagattccctggttaaaaccctcccttctcctggacgctctcagatacaagctgtgttgaactcactagcagctgtcacattctggcacttgcttgggctgtgaccagagcagtcttccgcccaaccagggaaggcacaggctctgccggcagagcaggggttaatggaagctgaccgcagcacagttgttaaggtaatcaataccactgagatactaaagcagtgtaagccacaatattgattgccaagcagatgataaaactgtttattatgataattgcagggtccctgcaagatgctcccagcgcttcctaaagctgtttacaaaactaataaagatttgccatttcaaggtcttccatttttaaccaccccccaccccgccaactccccacaatctcccactcccaaaaagcaggcctcacccctgggcggttaacatgttcttcccagggacaggcactccatggcccgtcctgggtggagcttcactctcagattctctaaagaacagactgtccttctccaccctcaccctgcccccaacttcaggaaggggaggacggaagcacagccgacagccactcagggccttcagatttcctccttaggacccgccatgtgataattatggggttttatcgatggaggggggctgctcagggctccttgggctgacatccatttgttctaacacatttaagaaaccacaccaccttggtttgtaattaaaacttctctggagaacttggtggccatgaagctaactgaacatggtcaaatgctgattgtagaatgcatttccgccaacactactcaactgtgacttgggctgctgaactgggcttgggtcccaagttctatcatgcccaaggcacccatttagtttttattagcagtggaaattaactccttcttggtcacagacaccaccgttttcctcgagacgcaagttattgaattatcggcaccgtctccaatgctgtcacctcatgttcaagaggaactgcaatgcagacatatttttcaatataagtaggcatctcgcaggtagtataatcatgttcttcggacctcttaggggaaagccactgggtcctgcgattaaggatggcagccccaggacttcagggctctgcaaatataccgaaggtgtgttttcagagtgtgaaatggaaaaaacatagaacccagccaggtgcagtggctcatacctgtaattccagaacttttggaggccgagtcagacagaccgcttgagcccaggagtttgagatcagcctgggtaacacgacgaaaacaaaaccccacctctacgaaaaacacaaaaattagcaaggtgtggtggcgagcacctgtagccccagttactcgggagactgaggtgggagaatcaccagagtccaggaggctgaggctgcagtgagttgtgggagctgtgatccagccactacacgccagcctgggcaacaaagtgagatcctgtctcaacacaaaacaaagaactcaagttttaaggagaattcagtagtcattccatcagcagctagaaggcaagcacccatccctcactcaactctcatagcagctaagaatattttacctgtaatagacttctacagcactaggccttcaaaacaacatttgcaattgaagggacaccactttgagagctgacaggccaaagtaagatgatgtggaggctgcttccacctcccaccctccccgatcaaagcatggagaaatcattcaccagtgctcctggtctccgttgccactgccacctcagtttaggtagagggacctctacctgccctattttcttcccattcagctgcaaccagcagctctgggaggtcattgcccccacactgtgcctgtgtacacatgtatgcttcaatggtgtggaccagtacagacatgcagctcctttatagacatctggttctgccccacctactcccaaacacacagaaatcagaacactggagccagttttatgtagagtatcattcgtttgccaaagaccttgccatgaactcatggataccacagcatggctggaagggatgcaccagggattcctttaacctggctacctgctcttagaggaactatttggcaaccaggaatggccggagggaatctgaggcttccctaggactgcctttcatgaatcacctgctcctaggcaaagtggcaaaggacagacaaacgccacctactgaactccaagctggacgccctattcattcacatatgctcacggggcccatgttaacaaacacctccctggatttgataccaaaagaaagtttaatattatatgtggctaattctgctgttaccttttaacctcacttgcacatatctgtcctcccaacaataacttcagcaaaaaacataccctaagaacaatatggtccacacttggaaacccgcccaacagggccagtcgagcctgcataagtgctaagaaccatttaggagcactgtaaaccattaaggccattagctctaatttgacctccacaaaatacatcaacccactaggaacaaatttagaagctttccaaagtcaagttctcaaaacctgaaaggctcataagcacagtctagggcagggaacagccagccagtcccggagctactcttcccgctcccacctttcctgcagctgactgaagggtgcatgcttagctggtacacggacccaagatccttctccagccactggatcaggaagctgtggccatcgaggggtcgatatgcaggctggaacccgccaaacatttctgattaagggattcactccagccttcctctgagctcacaccatatacaatcttccctctgcactgctctaaatcacttcttttcaaataacgcggatttctggattcatttccaagtgatcctgattggaattcaattgcactaactgggtccctgcaacaggtcagggttcacccagtctttcaatctataaaggcaggtatcatgtacattaagagccatgattcccccacattaatacatgtgtcaacacaataaataatttctccaacaaaacttataaccatcagcatatgctataaatttaaattgcaaaatcatcataatttttcatctttattcttcactgataattactgactgcattttttaatactgatggcatcatcttgatgaggaagcaggcaatgaaataaactacggtactggctaggcacagagatcacacttacaattccagcactttgggaggccaaagtgggaggatcacaggagcccctgagtttgagaccagcctggacaacatagggagaccccatctctacaaaaaatacaaatattagtaggaagtggtggtgcacacctgtggtctcagctaagagaggccaaggcaagaggatcacttagcccagaagtttgaggctgcggtgagccaagatcacatcactgcactcttggcctgggcaagacagcaagacgctgtctcaaattaaaaaaaaaaaaaaattaaaacagagccaggtgcggctgttcatgactataataccagcaccttgggaggccgaagcgggtggatcacctgaggtcaggagtttgagaccagccaggccaaggtgaaaccctgtctctactaaaaatacaaatattagccaggcgtggtgctgcatgacagtaatccaagatactcaggaggctgaggcaggagaattgcttgaacccaggaggtggaagttgcagtgggccaagattgtgtcactgcactccagcctgggcgacagacactctgtctcaaaaaaaaaaaaaagaaaccatggcactatcaaactccaccagccaatgcgagaagcaggctaagaacacgcatactaggtaagtggacagtgcacatggataagtcaacaatccttcagttgcttcaatgacaaaaacataccacatacttatttcactcatctttccagggcagaaggaagaaataagtgggaagaatatgggccaaatgagttagcagtaacaggagaagcaagatgcagcacacagagttctacagcccaggaagaattgccaaaagctgagtaatccattccagctccaccctgcatgaatttccaggtatcaaattatatgttaattatgcggacgcagagttatatgtggggaagtggtgttagtcagcacccaaggggtggaaattcagtaaaaatttagttttgtcaagtatgtttcatgcacaggcctggggctcctctggctcaggaaaagagaaagcaggagtcaggaggcccagacctttccctaacagggtcccacagccaattcgctggccctctctagaccaactttcccgaattataaaataccacaaggtttgggtttttttccccccaccgtttctgttcaaatcaaaaagcgctaagtcctggctgatttctgactcagccagtcaaaagagggacacgcctccctaactgcaggagggtggggaagggcagctgcactcagtccgatggaggggaaaccagtaaacccgtcccttggcactgtcacttggcaatttctgaggtttaagacgacacggcgttctcccaggtcctggcctgtaaatgccagggaaacgcattgtacttgtgaagagagagaacacagagtttcgaaactgctctaaagcccatgtctcaggctgcaagaacgttatcagtctcacacatcgtgcccctgcctccaaggcccccatcaccacatactgatcttgccctgatttgaagcgggcgggagagagctatggggaagtccaggcctgtcccagccacggatgggacaaacagacaggaactgagtgctgaagaccttgctgtagctgctgagcgatcttaaaagggatccaccctggaggagctgagcaccctcttctttccagttctcctcactttaaacgatttttgtctaataatgtacccaacaggcagatatcagagaagcactaaactaacaccttgaaatgggtcaataatggctgggcgcagtggctcatgcctgtaatcccagtactctgagagtccgaggcaggtggatcactcgaggccaggacttcgagaccagcctgagcaacatggcgaaaccctgccactactaaaatacaaaaattagccgggtgtggcggcacatgcctgtaatcccagctactcgagaggctgaggtacaagaatcgcttaaactcgggaggcggaggttgcagtgaaccaagatcgcgtcactgcactccagcctgggtgacagagtgagaccctgtctcaaaaaataaaattaaaaaaaaaaaaagagagagaaatgggttaatgacaaagaagtcctatacacagcatagtatgtactgtatagcattaggataatatagtatagcagtcccttatccgaggcttcatcttccatgacctcagttacccacattacagtacagtaagatattctgagagagaggagagaccatattcccataactgtcattacaggatattgttttaattgttctattttattattagttatcactgttaatctcttactgtgcctaatttataaattaaattttatcataggcatgtaggtagagaaaaaaacatagtctacctagggtttgatactatcctccctctcagacattccactaagtgtcttggaatgtctccccaaggataaagagggactgctgtcgtggctaggagtatatgctctgagctggcatcccagcgcagaggccatttaacagcagcaaatttgctacagactttgggcctcaagttcatcactcatatgatgggtgtaggatcatctttaccccatagggttgtaaggattaatgagacagtgaagtatttagcacagtagatgcttaataggggttagctattaatgcttatattaatatttattaacatttatacagacaaagaacatgttctcatgtcatttgcatagcaatccaacaaaggccgtattctcacttttgaggctcagagaagcagagagacttgtccatggtcacacacaagtactcagacttccaggccagtgtcttttccatcatcttttttcagggtgtttcacccacgcaacactggccaggggctagatggttccaggtgggagtgggtgaactttgtacattctggtcattagccagtcaatgtttatctgagccaatccaaccagcacgagcctgtgattcctcagacacaattgctcgggatgatgctaaggtgggtatttgtggttataacggaggatcccgtgaaaagaaaaatgtaaagcaaataatacagtataggcagtacaaagaaacaacagaaatgatgccctgagttgggggcagaggggtctcttccactctcagaggctgtcgccgaactgatctttctcacatagtcaaccattaaaagtccccaacccacaggtcctagtttcttctaagtatccatctccctccttgctagagcagagcctccaaaatgaaagcgtttctccgccttcctccaggcctcctgagaaaggttatgagatgggttatcagcctctctgacctctgcagccatcaacagcacttctgcctctcccatcccccacagcgaggatcctacagcccagagccagcttccctgccttcccccattaatgcctttcccctccaacagctatcacaagagggctgtttagtgagaggacctccggctgacctttgctgacaggctccaagctctccctgtaaacggatctaatgtgaggctgggtaattagcaaccaagtagtaattgcagcttctaactatgctcggccaagattgcaaaaattccctaggggggtgcctcctagggatcccaacccacacaaaggcatttactcacagccaaaagaggggactcagccacatttctcatggaggccagcacttctctaggtcttaattaaagtggcacccatgtaaagagacagacagcaaaaggaaattagcaaataaaggagactgaccaagaaagaaatgtatggcttgcttggaacagcccattcagaaaggtacaacctctcaaggtggatggccgtgcacacgaaactcattccagccgcggaaggaaggcaccaaagagccttcgaggggcatcaaaaactgcagaaaggccaggcgcgatggcccctgcctataatcctagcactctgggaggctgagacgggtggatcacctgaggtcaggagtttgagaccagcctggccaacatggtgagaccccatctctactaaaaatagaaaaattagccgggcatggcgctaggcgcctgtaatcccagctactcccaggctgaggcaggagaatcgcttgaacctgggaggtggaggctgtggtgagccgagatcgcaccactgcaccccagcctgggtgacagagctagtctccatctcaaacaaacaaacaaaaaaaacaagaactgcaaaaaggcaggacacatgaagacaggtcccccggcctggctggccagcctggctgcctgctcctatcacccactcaaccaaaatcactcctcacccaagcaccctgtatggcccactgttcgcatcacaagattctagatgccaggccatgtggtctatgctaagagatccgtagtatcatctgctatgatttggtgattccaccagacctgtccacaggcccccctaccgttagctgcctacatgtattaacatgtttcagaataacgtgcaaaatccccattgagaaataaagatgtgagcacttccaaatagagcagctgccctcctcatgactctaaaaatacctaaaactgcacaaaaaagaacattgtcagacgaaaagaatcatccctcctcactctaacaggacaacaagcgatgcccaacagcacagcagcgcctgtttcatccttcctaagaaaaccctttatttttcaagcccaccactccccactccaatttcctttatctgttttgtacttaaaaagtcacttcactgaactgctgtttgctcacgataactcctgaacctctgtcctcaggagaggcggcaagttcagggggcatggtagctttcccacgtggaccagactttctgccaacctgaattacaccctagacgtcttcaaacttcatttcctctgccactgtgctgcccgatcccccaatgcattcggggctgtagagactctctgggttgaatccagttataaaaaccagggtagcagcagccgagtgcactaattcaccctccatttccttctccaaacaattaatatacttaataactccagccccgacgacagatttctcagacacccctctattaacctctccccgctacaagcagtgggtctccaccagaattcttctgttccctatcacttaatcattttttaatccacaacaaggactttgtgccacactgtggttttgttctctcttaatcttttataagggaccttatcaaaagcttttagaaaatacaagtgaattttgcctaccaggtcatctttattattttagaattctttatgaagaaattatagactttaacattgtaaatgaatatttaagactcagcattcacttagacatgcaagtctggctcaggttatatttaagtcgctgtattacttccaccttcagaaggattcttgtctgcctcctgggatggaatgacttcccctccccaagcccccaggtgccatttctgggattcccccaagactttctggaccagctgaaattgagtccatattgagtaccaatgggacttagagtgcattaacagaacctcaaaccaaggaacaaaagtcatcgagccaagggggcctggctatggcagcctatccgactcctacctcctctacctttccccaggtggatggcagggagcagcaggctcccctgcctcacagctggcccgcacatctgcagggagccaatgacagcttcttgatgttgacatcacttaggctgcctcctaacacttgtttgttgtagctattatttctaattagcacttctcaacagaaccagtgctcagcaccaaggttcctcctgacggaacaattaaagaggcacaaggggcgggggtgtttcctaaaattattctcttggcaggtttcaaggtaaatcatctagtcaaatgcacatctcttcaagagctgcctgtggacagggttgaaaagctgtagcaatattccggaacccctgtttgaaagcattcccatcaagttaaatgaagggttaaggtaatccaattacaccaatgtgttttcctgatcaccaggggaatcctcagccttccccgtaatctgctcctaacgccccatttagtccaatgctgcactccaatcaccaaaaatgtagacagggttcccactcctacagccagatgagaggtgcctgccccttctccaaaatgggatggtgaaattaacacatttcagaaaatattctacagagtccagagtccagggcacgctttatccttgaggaaaataataaatgtcgagtcctaatggcatgtcaattaaaggggtcaccataaacaagctgttcaaactttcccctccactcttcgcccgtgcctctccaatctgggtgccctggaggacggaacgggaactgcagatccaggcactccattatggcaacccagcaagcagttcagcacggacttaatgagctcttggaaggaaacaggaagtctataaagtaatttaaataacttccagtcctgaaataaaggaaattaaaccgctggcacaaacctctctgatggacaccttctttgtccctccgatcacaactacaactacagcggtcatattgctctccccaagaccaggccccaaattcccctaatatgaaacacaaaggctgtcagtcctcagagctctccaagctcctgcagaggcttaagccatggatgtggcatggtgtgcagcaagaacacgggaatccgcccacaaaccccgcgctgggtcctgccactccctagctgcaagaccttgggccaatcatgcaacttcacagggcctcagcgtttcaccatcaacaaaggaaagctctgggcctggccaaatgacttctaagattattaagagggtcaaatgagcacatatgagaacagcgccaattgaaaacacaaataaacgtcggtattttccagctgcccagggccttaggctccagaatttctcgatgttctgctcaggaggcactgtcctatcttggtaattatgaaggcatattcatacgttcttttactgccaggtgcggtggctcacgtctgtaatcccaacactttgggacaccaaggcgggtggatcacctgaggtcaggagttccagaccagcctggccaacacagtaaaaccctgtctctactaaacacacacacacacacacacacacacacgagccgggcatggtggcgggcacctgtaatctcagctactcaggaggctcaggcagaagaatcacttgaacctgggaggctgagattggagtgagctgagctcgtgccactgcactccagcctggtgacagagcaagactccaacataaaataaataaattaattaattaattcgttcttttgcttctcctaagcccctcagtgtagatacttatttgcatggacaatgatcagtccaactaagcatgattttcttatcagcagagactgtgtcttctcatcttctgtaaaccagtgtgcccagagccagagcaccaagcagccaagaagctggtcctcaataaagggctagaatctataacccatgcagttatccagacatccttaagcaccaaaatgctaacaactatccatcaactctctacaaaaagagacaaacctaataacaagataaattccataactggttgtgagcctacaaggcggggaggggctgggggcgtgggaaccccgcctgtgcaactccttgcattaccaggccctgccctgagtgcaatccaaccacggagttctggcagtttcacctggtaaacctaagctgctggatgctaaggactgtttctggccacagagttaagtttactttgttgataataatcagccagatatggactggtctgaccagtactccggatccaggatcacaaagaaaagacaaacttaaaagaagcttaaggtcagcctcgttttgctagccctctaggtattactactgacaactggtatggtcaacccttgacccctaaactggtaaaagccaagagtaaggctggacattcagtgtggccaagaaagctacccagcttctgggcagaagcgcaagatcctggtgctccggaaagagaaccgttgggcccggctcaaaaacagaccctcccaaaccaaccctgagaaaggaaatcacaaacagaaatctaacttttctataagggcacactgcacaagtgttcctgcagcttcacaaacaggttctgtgggaatctgctctatcgctcccatctgtcactggcggggtaagatctgtcttgcatatcatggcggtctccatcccactggagaattcaatggtgctgtcttgcatatgggctgtgaaacttgaacaaccggattctgagggtccagacgtctctgtttgagcaacagctgccttcctttaaaggtcccacagttgagcaatagagttctttactcaagagggctgttccaagtcttgagtaaccacccttgccctcaagggttccccagggtgaagccccattgcctctgcctcaccaaggaggcagcgactcagtcttctcgctacacatctgtctcctcactttccagtcagatcacagccagtgggacacaatctgacaaagttctgtctaaggtggggtaatctgaaaagcaaatacagatcatctccccccagacttattcacagcactccccactggagccaggtttgactttccacaaagttcactggccagaatcataacccacacatctatggctcttccttctttaaccatctttcatgtaaatccttcatctaaaaggggaaccacctatctatgaactttaaatttcccagtatccatgttaaaaaaggggaggggcctggtgcagtggctcacagctgcaatcctgacactttgggaggccgaggcggcaagatcgcttgagcccaggagttccaagaccagcctgggcaacacagggaaagcctatctctacaaaaaaagaaaaaaattagctgggtgtgatggtgtgcacctctggtcccagctactcaggaggctgggataggagaattgcttgagcctgggaggtggaggctgcagtgagccatgattgcaccactgtactcccgtgatttaaagcaagaccctgtccaaacaacaaaaatgaaaacataaaaacaaaaaaataattcaaggctaggtgcggtggctcacacctataatctcagcactttgggaggccaaggcaggcagattacctgaggtcgggagtttgagaccagcctggccaacatggtgaaaccccatctctactaaaaatacaaaaattaaccaggtgtggtggtgcatgcctgtaatcccagctgctcaggaggctgaggcacaagaattgcttgaatccaggaggcagagtttgtagtgagccaagatcatgccaccacactccagcctgggcaacagactgagactctgtctcaaaaaataataatactaataaggggaaaaaagaaacaggtgaaattcattgtaatatgtcttatttaaccgaatctgtctacacattatttcaaacgtaatcgatctaggttttattaagacagtttccccttgttttcctactaagcctgggaaaactggtatgtgttccacactcacagtatggctcagggcgaaccagccacatttcgggtgcttaggggccacatactgcagtaatgtaaaaccctggcttcctctaatcatgagaacctaaaacataactctgatctggccccactgtaataattcatgcttgtagttctcactcacagactttacagaacttaccgctgctcaagactctttcccacggcattaacaattatatttgggtgacatgtcaagaagttaagctgcccgggcctggagttaacagattttcacagaattgtgtacaacttatctggtccatcagatcgtctctctggggcttgtccaccattaaactagacccctggggtttcttaatttaaaatcctcataaccctttaacttgaaaactcactgtctttgcaatgacatgtggttaactctgtagtagccacataaacatctcctcattcttaaacaggagacttccattttgacctaatctgagattattctgaattatttctgccctagtcacatgtacgctacagacatgagattacacagaataatcaactgaggtggtgcctacacaatcttttgtttttttgttttgagacaaagtcccgctctgtcgcctaggctggagtgcagtggcaccatcttccctcactgcaacctccgcctctcaggttcccaggttcaagcaattctcctgcctcagcctcctgagtagctgggattataggcacatgccgccacacccggctaatttttgtatttttagtagatacagggtttcgcatgttggccaggctggtctcgaactcctgacctcaagtgatcctcccacctcagcctcccaaagtgctgggattacaggcatgagccaacatgcctggatacctggaaaatcttaaggcacaaacaaacacaggacaaatccacaggcttgggaatcactataagcagaagaaaaatgtccacagggcataaactttggaggcatgctcacagcaaccgctaaccagaaaacttcgcaggctcagtccagatctgggcaggattggctcaggggtgacccatctatcctgagagctgtcaggaccccatcctattgggcacgatacaagtcagacatgggacagccttcgatgccagcgtgggcaggggtctcacctgagcccacgagaccacacacactttggcagcaactcttgaatcagtcaattttcttcacaccataagtacatacttcactctctccgctcagcagctgcacctgccctatctggtggagtggaggacactggcaagctgaaagcttctgcaggctcatccatccagattcagctctaagagcagggcaacccggggaaaatggaaacatacagaaaacagttcacttctggcttgtcgctttggctgcaggcaagagaaggtgtgcacagagttttgaaggaaagactggaatgggctgacactgggctttgttcccggagccccatggggacagggctggcttccgaacctagaaatgcagagagctgctctccaacaggtggagggcccacccgagtaagtatcccgggcagaagaacagagcaggcaccactgtctgtcaacaccaggctcggcatcctcccatcccccagggtccctcgacctgtccccagggcactggagagaggagggagggacgaagggcacgcggtgaaaggaaggaaggaggcgcctcttcttggcgagctgatgggtgtgagtggtgagcatgaattaaaaagccatccgggaacaatggtcttttcatatttggagcctgttctgcacaaagctcagcttgttctagtgggaggactctgctttccatttttttcctaactcatttcctagggttgtggcaatgtctggcactcggctcaacccaatagagtatcctttaactgaaggatgtgccaggcaggcctcctccttgacttcgtaagtggtggcattgagacacacaaaaagggacaacttcaggaagcttttctgtctcgacccgtgggctcccaaagagctcctgggtgtttctctgaatagctgcctaacccacagaaacacacactggatgttttcagcggccaaacacccatttccctctcaaattacgctagacatgccacacccagcagacactccaaagcctaactggaaaaggacagcggatgggcgtcagatcatgtgacaagaccttcctccacgttcgacacactcctggagtctctgctgaaccccacaaaccccttaggcaaagcaattttgaaactgggggtggagacaagaacagcagccaacactaagcaatgaagctgttcctgacacttgaacaaactgtcgcctcactcagtccttatgatccctggtgggcagcctctaagccagatcctccaatcccaccccgtggcattcacacccttgtgtagtcccctccccttgggagtgagcaatacatagggactcacttcttaccaacagcatgcaaatggaataggacaaatgtgataggacaccacttctgagatgaggctgcaaagaaaccgtcattttagtcatctgcacccttctcctcctcctctcccttatggaagccaagtgccccattgtgagctgctctgtggtgagacccacatggcaaagaactgagagcagcctccagccagcagctcttggggaaatgaatcctatcaacaaccgtgtgtgtgagcacagatttcagtctgtccccagtcaagtcttcagatgagaccacggccccaggtaaacactttgaccttgcagcaggggacccagctacgccacagcccgattcctgacccacagaaactgtaagataataagtgcttgccattttaagctactgaacttaggggtaatctgtgatgcagcaatagataacaatacacatctccattttgcaaatgaaaagatataatggaggccaggagtgctgactcatgcctgtggtcccaacactttgggaggctgaagtgagaggatcacttcagctcagaggttcaagaccagcctgggcaagatagcaagactctgtctctacaaaattttttttaaaaaaaggttagccaagtgtggtggcacatgactgtcgtcccagctattcaggaggctgaggtggaaggatgccttgagcccgggaggtcaaggctgcagtgagccctgactgcaccaccacgcacttcagcttggacaagacagtgagacccttcaaaaaaaaaagggggggaaagaaaagaaaatatataattttggccagtaagtagcagagattctcacttaggccagactgactctctctagccaccttcctctcaccatgtggcattacctatcaagcccacattccggtccatagaccagaaaagcagcaaaactccctgggcctctctccatcctcacagatgacagagacacctaacagtcatgcccccaaataaaaggataccagattgctttggaattttagggttgaagaaagagtgaggagagaatccagtctaactttcttttacagataaagcatctgagacccacagccataaagtaacggacatggaactcaaacccccgccaggatagcacgtgactctttagggattccaggaaacttctactcaaacatgctgaacaagcttctacttctctggccaggagaactccatcagtaactctggtcttctcttttggcacaccaagattaatgctctgtggtggctggctcccctggcacttggcagcttctcctatacctgccccctaagtccttccacaaagtgacgagatagagaaggtagatcagagcgtcttctccttggttaataccagaatcgacatatcacatatcacaactgcatactgcccacccagcttatgctgaggtgtgatctaagtttgctttgaaattcagtgacatatcagaaagacagcacacacatttccatcaagacagctaacttgggcaaaggtgttctcaagtacccaaggcgattgattccacaagcttgcagatcactaagacttccactatttttacaaacacataccatagatgcttacagtaaatatcataaataattaaagctaagtagcctaaggacattttgtgaagcatctttgctgcttttttttaaattaggttctcgctaattcacaagattgaataatctccaaaaagcctccaaacacagccacaggccagtgctatttaagtgattctacatttttgcaaacttttaagcacatattttcttctcatgacaaaaagtaatagatattcactatgcggagctcagaaaacaaagtattaaaagtagcctgtacttctaccagctggaaatagccatcagtcatatgtaattctttagcttctcttctatgcatattttaaaaattaaactgaagtcctatagtccacagagttcctttcattccatttacatcactgttttcccacatttataaccaggaggcaggagttttaaatagctgcataagcatctaccatatggctgcaccacagtttaaatcaatcccctgtaagatttttcagatagtttccatttttcactattataaatgtctgttataagtgtctgtagcaaaaatctttatgtataaatttcctttgcacgactctcagggtttccttattacaaatggagttgtcaccagtcctgatccgggtattagacgtaagataattaaagggaaaaaaaaaaaaaaaccatcagacaaagactccgcccttgtgaagcttagattctagcaggggaaacaatcaaggataatacattttttgctaggcacaatggctcacacctataatcccagcactttgggaggccaaggtgggtggatcatctgaggtcaggagttcgagaccagcctggccaacatggtgagacccccccctccccaccccgccccatctcttaaaaaaaaaaaaaattagctgggagtgatggcgggcgcctgtagtcccagctactcaggaggctaaggcaggagagtcgcctgaaccagggaggcagggattgcagtaagctgagactgcactactgcactccagcctggacgaaacagcgagactccatctcaaaaaacaaacaaacaaacaaaaaggataatacatttttttaattgtatagtattttactagtggcatatggtatggtcagaaatgcagaggcagaacagagtgagggggtcaggaattcacggggggaaaagctacacatttaaataaaccttaaagtttcttgacacatactgccaaatgatcctccagaaagggtatactaatttttatacccaataaccagatcagggtatttgcttttttttttttttccacttagttcaaaaaaacaaaacaaaacaaaaaaagctcaaccttaccagtaatcaaatacgttaaaacaatgaggtctcatttggctcttcaaatgggcagcctagatttattcttcatgaattgtccatttgtgttctttgcccatttatctctttttatttttgtttaccacaataataactacataaaaacacgactttttttttttttttttttttttttaagtagagacaggtatcactatgttgcccaggctggtctcaaactcctgggctcaagcaatcctcccacctcagcctcccaaagtgctaggattactgtgcctggcctccatttttctctatctgtatgcatcaatctttttttttttttttttttttttttgagatggagtttcactctttcacccaggctggagcacagtggtgcaatctcggctcactgcaacctctgccttttggtttcaagccattctcctgcctcagcctcccaagtagctgggattacagatgcccaccatcacgcccagctagtagagatggggtttccccatgttggccaggctgttcttgaactcctgaccttgtgatgtgcctgcctcaacctcccaaagtgctgggattacaagtgtgggccactgcacctggctgtttcattcatttttaagagctctttatatattaaggatttaggacacactgtcaattccatgtgctctaaacaccttttcacagtttgtcatatgccttaaaattttgtgattagtgaccagcatgcacaattttttttaagtagactacatcaatcttttctattacaatttcttccccacaaggcttaggcctaatattcctcactgccctatattcagatcaatattaacctatattttcttctagctcttttgtgattttagttttacttttacctctccaactcacctggaatggatggtaacatatgctatgaaaaatggctctaacctaatttttccgccatttggctatctaactgtcctacaaccatttattgcataattttataatacgagaggcagtgaagtgcagtgatagagatcactggttttgctgtcagttacatcagtgtccaagtctggctgactttgagcctgttacttaaactccctgagcttcggtttccttcactataaaatgaactattagtaatgtattagtagtatccaattcatctggtttttatgaggattaaataagttcatataaagtcttggtctggtgcagtggctcacgtcttataatgccagcactttgggaggccaaggcgggaagataatgaggccatgagtttgagaccagcctggccaacaatggtgaaacccagtctctactaaaaatacaaaaattagctgggcatggtggcgcacacctgtagccccagttacttgagagactgaggcaggagaactgcttgagcctggcagacaaaggttacagtgagccaagatcgtgccactgcactccagcctaggtgagggaacaagactctgtctcaaaaaaagaaaaaagttggctgcgcaccatgggtcacgcctgtaatcccagcactttgggaggccgaggcgggcagattacgagaacaggagatggagaccatcctagctaacacagggaaatcccgtctctactaaaaatacaaattagccgggcgtggtggccggcgcctgtagtcccagctactcgggaggctgaggcagaagaatggcgtgaacccgggaggcagagcttgcagtgagctgagattgtgtcactgaactccagcctaggcaacagagcgagactccgtctcaaaaaaaaaaaaggtcttcagcataatgcttggcacttagaagttctgaagcgttatgtgagctgttactctgattcctctcacttaacatgaaatacaacctttaccagacacatttctatttgattccatcccactgagtgatctctatattttctaaccagtttttcccagtatatgagaaagctaattatcttttaaaatgttacgttgtaactgaactccttaattaaatttaaatgtgtcttgggccactaggaagacagtaacatctggaaataattttctttgtttctttttaaccattatttgactttggtttgtccatcctgaccagttcaataaggtaggaaaaagaaattagcaaattagtatattccatagtctccattgtgttcccagtttcagaatgttgcctctcatgattcatcactaagtctgagggtgttggctgcctgtttcttcattgagaagtcaatgcatcctctttcaagcttgagttttcaaaattctaagcagactaggaataagggtagaaaattaccaaatgcagtcaagtgtgacggctcaagcctataatcccagaattttgggaggccaacgcaggaggataacttgaggccaggagtttaagaccagcctggacaacatagtgagaccccaatctctatgaaaaaaaaaattaaagcccagcatggtggtgtgtgcctgtagtcccagctactcaaggtgatgcaggaagactgcttgagctggaggtcaaggctataatgagccatgattgcaccactgcactccagcctaagcaacaaaacaagacaaagaaagaaaagaaagaaaagaaaaaaaagaaagaaacgaaagaaaaggaaaggaaagggaggaaggaaagaggaaaggaaggaaaggaaggaaggtgatcaaatgtatctctcacacacatacacacagacagacagctgtcccttgctatatctcccatagatcccgaaaatctgaggatagtcaagtccctgatataaaacagcataatatgcacaacctcctgtatactttaaatcatcttttgattacttataacacctaatgcaatgtaaatgctatataaatatttgttaaactgtatcatttaaggaataatgacaagcaaaaaggctgtcgagtccacaggtcctttacatgttgagtaaagacccaattttttccccaaatatttttgatttgcagttgctggaatctacaaatgcagaacgggtgactatgaaggccaactatattatgtttttcttcttggctctacatacatgattatttcaagagaagacattctgatattaagccccttcttacatttccaggataaatcctatgtggttatgattcttttaaaatgctaaattcaatctgtgactgttttatctggcatttttgcatctccactcatgtcggaactcaatcttcagctttctttttgtgtaacctttgtgatggtgttggttcccagaattatgctagctttgtcaaatcaactgggatgctttacctctttttctattccctgaaacagtgtatttagcaggcaattatagcatccctctaagtttaaaataacttatcctttaaacttcttgcatccagagccctcctcataactgttttttgtttttgtttttttgagacggagtctcacattgtcgcccaggctggagtgcagtggtgcgatctcggctcactacaatctctgcctcccgggttcacgcaattctcctgcctcagcttcccgagtaactgggactacgggtgcccaccaccgcacccggctgattttttgtatctttagtagagactgggtttcactatgttggccagacaggtctcaactcctgacctcgtgatccacccgccgcggcctcccaaagtgctaggattacatacaggcgtgagccaccgcgcaaggccagaactttttttttaatgctcagcttcttccccagtttctgatttaaagtttcagacatccaagtcatttcccaacagccatgtcactgggattttcaaaggtgttgcattttaagttactgtgttttacattacaaaacaattacttcaaatgcaacttacatttgttacactttttctatcatatcaattcctttttagttttctgtatttggggttttctcttttctcttttcttaattaaacatgatagtgatttggtctacttccttggccttttttcccaaatagcttttagatttatcaattcagtgtttttatctgtttttctaattcattaatatcacttttatcttacaattcttttctccagctgtctttaggcttgttttatgctttccaagtttgagttgaatacttaattcatttattttcattttctttaataatgttttaaagctacaaatgtgcccctgaatataactttggtaataacccatacatttagatatacagagttctcaatatttcctaatgatcctgtaacagtaacttcatttcctctttgacccaagtgtgatttaggagaatatttttaaattttcaagtaactggatttcattaacatgtttaagtattctatggaggataaaaacatctctgaaaggagatgaaactctggcaaataaaaaaaaaccttttaaatagaaaacacgacaatgttaaaagtgaaaaatgactcatataatgctgtgatggccatatctacagacactccttgtagaagggatataaccaccattggtcctggggcactgagagatctgagtgtaagcaacacaaggagagagggaagaggatgttaagtctctgtgccttctgaaaattttatcttgggcatatgctgcttgcttatttcagaagcaaagtcacccctcaataaatggaataaaaccatcccagatacaccatctaagtatataaccaagtaaacttccatatttttttgatgaaatttagagatggcttcaattgagtaagacttggccccaagatgattacatctgtgactaaagaaggcaggagggaaaaacaataatctctaattctgcaatctccaagttcagaagaattgagagctacaagaaaaataaagtatatacgtgtgtgtgtgtgtgtgtgtgtgtgtgtatgtgtgtatatatatgttaaaaagcttaatgaggttccaactgggctattttgaaacctaaatgtcaggaacatgaagctgaggcagtacagtagccagttccctgtatctccttacgcagcctttcccattttacaattactacatcttgtagatcttgcctgctacagaccttaaaacgcatttcaatcccaaattaattgaattaacttgtgcttataagcatcataccgtatcaactcccttccttcccacaaactttgtagtgccaagttaaaaagaaaagaaaaaaaaatggactccataaatcagttttccaatttacgttgaagaaatctgtttcctactttctaatttctgcaactgggaaattctgtatattatgttaccatataatgaaggatgccggtaaacagaaatccacacgcctgcacacacaacagattacattgtatgtaattgcaaacaccaccaagttatgtactcttgggagcattattagtgagatgtggttatttaatgcttcatctatttaaaaaaaaaactcattccatatggatgaaaaatgagtatactagcctgaatatgggaaaaaaatagaaaatgtaatcatatattacttaaaatctataacgttttatgcaaagataaggtgttagtaccaaacttaggcattcagaatgtctcaaatacaatatcatgggctaattgctggctaccaaaacctccatcccccagcagcagatggcagggccagccttttgtactttacttgaccatttaagaaactcacaaaggggccagtcatggtggctcacacctgtaattccagcactttcagaggccgacgcaggcgaatcacttgaggtcaggagttcgagacaagcctgaccaaaatggcaaaaccccgtctctagtaaaaataaaaaaattagcagggtgtggtggcgcacgcctgtaatcccagctattcaggaggctgaggcaggagaatcatttgaactcaggaagcagaggttgcagtgagccgagattgcatcactgcactccagcctgggttacagagcgagactccctctcaaagaaaaaaaaaaaaaaaaaaactcataaaggtacacagcacctgggggcttccattagcatcagaacacccacggaggcacgccccatgggaaggtggcactcagctcccaccacagagcaaggccctttaacagcgaagatgctgcagggcactgctactcgccctgctggggagaagccacccagcagccaccctaggagcctggcacagaatgcccagctgtggggaaggaaactgtgccacctgcatcgcccgtgtgccaaatggagttcaagactctgcaccgttccccattcatccccacgagaggttcagcagccactgccgctaaaacaaaagacggatgacaggaaaacccgctggcctttggcccattccctagcaaaggggaagtgtaaaagtgcaaaggggaaagtgggccagctgcactaatccctctttgtccagcagtaattaatagtataatccacatttcagatgcattaaagcgaaaatgctgcattatcagagagcccggcacacagcctcagggcagagcctccctgctgacctgcagaaccaggttacctcatctcagcctcctcctctcaggggagctgactctagacacctcataaaaggaccgagctggcagccagaagtctccactctgcctgatgtgctgtgtctgtcttcagaaaccacccactccagagccagtcctttgggcacacgagttctactccaggagacatttacatcaagttctactctctgaccaacattgaacattttatttttattttatttttttacacagagacagagtcttgctctgtcacccaggctggagtgcactggcatggtcatagttcactgcagcctcgaactcctgggctcaagtgatcctcccaagtctacctcccgagtagctaggactacaggtgtgcaccaccgcactgggttaattttttgtttgttttattttgtgagacagggtctcactcttgtcatccaggctggactggagtacagtggcgtgatcttggctcactgcaacctcgacctcccgggtttaagcgattctcccacctcagcctccccagtagctgggactacaggcatgcaccaccacaccgggctaatttttgtattttttggtagagacggggtttcaccacgttggccaggctggtctcaaactcctgacctcaggtcgatccgcctgcctcagcctcccaatgtgctgggattacagacctgaaccacttcacctggccctggctaatttttttttttttaattttttgtagatatggggtttccctttgttgcccagcgtggtctcaaactcctggcctcaagcaatcttcctaccttgaactcccaaagcactaggattacaggcgtgagccaccacacccagcaacactgcatatattaatatcacaagtctgggctgggcgtggtggctcatacctgtaatcccagtactttgggaggccaaggtgggcagatcacgaggtcaagagatcaagaccatcctggccaacatggtgaaaccctgtctctactaaaaatacaaaaattagctgggcttggtggcgctactcaggaggctgaggcaggagaatcacttgaacctagaggcagaggtcgcagtgcatggatatcatgccactgcattccaggctagtgacagagcaagactcaatctcaaggaaaaaaaaaaaatcacaagcccccctgtggattcttaagctttaagctaactcccctccccccaaaatactgggataataaatgcaaccaaaattaagatgcccctcctcaactcaattcggtgggatacctttttttatcttggtgttatttgggtattctgcactaattctggggcaccaggtaagtttctatcgaggggtagaagctgacttctgtccccgtcccccaagaccaaagaggaagcctcttctgccaccactgaaatactatctttagaggaaggcatgctattagctcatcaagcacaaaacacattcgagctaaacattacagtcaaatgtcacagccacttcaaaatagaggtacccaaaaaggcagtcagtcttctcagcagggctttgaaaccactgccaactgagaacttgatctcaagtcttccaacaccaaaacacctggtggaataggtacaactaacgggcagacagcctcaaactccattcagctccacagcgcctctccatgaccactgcagctcaacctctgtgctgggaagtgcatgcataggatggagccatgtttctagaaccatcagagacaaattttctactacaagtgatactgcacatgacagtttattccttggctggcctctgatagtatgcatttgaaccatatggaatcaccattttttttattaaattagagctgttaaataataacatcatggaggaatgtgttaggttctgggcaaggatcttaaatacacagttttggaacaagtgtagggaggggcccaagcccacggccggtgcccaacggtggctacacactacagcagcaaccggccttcatcctccaagtcctccttggaatttgggtgaaactacttatatcttaatctaggcagctggagatgaagacaaagacaaaagagaagaggagagaaaaggaaaataatttgatagaagtattttccatcccaaattttgagatcctggcacgaatgatataatctagatacccaacaacctatacttgttccaaaatcgtgctgttaagatccttgcccagaacctaacacgttcttccatgatgttattaacaactctaatttaatccaaaaatggtgattccatatggttcaaatacatagtatcagaggccagccaaggaatgaattgtcatttgcaatatctcttgtagcagaaaatgtatccatgctggttctagaaacatagctccatcctatgcacacacttcccccaggactcctggactgccaaaggcagcctataagccatcaactagcaactggacatttcatctgggcgctcaggaggtacagacctaccaatcacgggagtgaaggtacccaggccaaggggctgtacaagaagggcagagaggaggccaccatcctgaacacatcacagactgcccatctgtgcccttcaagtgacctctaaagtgtggtatcaatctccactgaacctttgctcttattcccacaacacttggattctttctttacagggacccatgtgaaaactctttatttttttattattattatttttgagacagggtcttgctctgtcgcccaggttggagtgcagtagtacgatgttggctcactgcaacctctgcctccctggctcaagcgatcctcccacctcagcctcccaagtaactgggaccacaggcgtgtgccaccacacccagctaatttttctattttttgtggagacagggttttgccatgttgcccaggctggtctcaaacttccaggctcaagtgatctgcctgccttggcctcccaaagtgctgggagtacaggcctgaaccacggtgcctggccaaaaaccctttataaacactctcttttatttttctctcaagtatgactctttgggcctcaccaaaatacaatttcacaaaataatgtcacattatttgggggaggggagaggccaccaaatttcatctcgaagcctcttccctcatttccaaggaaataggcattgttggaacaggtaaggctgtaatatttggtttagctttgccctcctgagccacctacctctagaggcacgtgggggtctctttctttgccaactgcaccaattcctccacaggaccgtgcagtagctgaataacaacccccgaagacgcccacatcctaatatccgtaacctacaaatatgttaccttctacagcaaaggaaactttgcagatgcgatcaagtgaaggatctttggatagaggagatgatcgtggattatccagggggcctgatgcaatcacaggggtccttacaacaggggcaaaggagaggacagagtcaggcagaagaaggagatgtaacagaagcatgacacagagtgatgtgaggaaggggccatcaacccagaaatgtgggggcctccagaacctagaccatgcaaggaaatgggttcctcctcgaaaccgctacgagaaagcagccctgccaacaccctgacttcagcctactgaaactgatttcagacttctaggctccagctacaaggcaatcagtttgcggttttttgcatttttttttttttttggaaaaatgaaagctgatttttattttatcatcaacagccattctttagacatgaacatgcatacgtaatattctatgcacacatcgcagttttgaacattagttaataaagtttaaacatactacatccttacagaaaacatcaaaatgcaaacttaagtttgtgttttacaccaacaagtttgtggtaatttcttcttcttttttttttttttttttttttttttttgagacacagtctcgctctgtcaccaggctggagtgcagtggtgcgatcttaactcactgcaacctccgactccctgcttcaagcgattctctgcctcagcctcctgagtagctgggattacaggcaggcaccaccatgcccggctaatttttgtatttttagtagagaaggggtttcaccatgtcttgatctcctgacctcatgatccacctgcctcggcctcccaaagtgctgggattacaggcatgagccaccatgtccggcctatgtggtaacttcttacggcatcaagaggaaactagtatagccatctggagaaagggggacagaaccactggacacacagaagcaggggtgtccctgaagggttcaccctaccaaggggttcacactaccctccttctccagaccctagggaccagctgaaacctctctttctccatcaccaaaaattaggaccaaaggcctcagatgctgtaatcaagagctgtgtcttttttttttttttttttttttttgagatagggtctcactctgtctctcaagctggagtgcagtggtgcaatctcaactcactgtaccctctacctcccgggctgaagtgatcctcccacctcagcctcctgagtagctgggactacagacgcctaccaccgtgcacagctagcttttgtatttcttgtagagacagggttttgctgtgttgcccaggttggtctctaactcctgggttcaagtgatccacccacttcagcctccataagtgctgggattacaggcgtgagccaccacaccggccacgagggctatgtcttaggagaggtgttcagtggagtatcttagcattagacagaaaaaacctcccatcctggcctaccgcatttgagatttataaatatccaaattaaccaaggaaacaacagaaaaacagtagttggacaaagagtttgtgtgtgctacatgtttattttatctaataggagacaccgaactagaaacatctacattcaagaagaatccctggatccacagttccttttatcaattcacaaaagccaggccgagccaaccttacccaatatattccacaggtgggcccgcctgaagcctcgctgtgatgccaggcagccagcctgaagaactggaaagccagggcccgtgcacgctgggctcctgaagacaaaggaaacagaatggctcgggaaggccgtggcaccctgcccgcctccgtggtagcctggggccactggatcttgctgtctccgcagcacctgagaggtgtgagccaggcagccaaccacatcagaagctggctgccggctgccccaattgcacaacacctccaggggagccagctttccaggactgggttttacacaccatacgggcactggccatgttgacccagtcaaggcatggcaccttgaagaatggcccacgcaaagaccggccatatggacagaaggcatcctgccacagagcgatttctgaatcacctctatgcaaagaatagtcttctctcttacgcaaaggagatcccatcaccaccatctcatttctatcccaggctcctccagttctctttcaatcacaagccagactacccaaccacttaactctctaggcccagatatgacttaattctcccactcctgcatgtttgttgccacttccccattttgtgttaacaattaacctgaagtattatgttaacaattaacatgaattgtgttttggtttttaaggtcggagtaactaggattactcaataggatttaaatgttcaattttagcacacatgtacaaggcgctactttgtacatgacaagatgaagtggtttaaaaaaaaaacaaaacataaccacctttcacaaagggttctcattcagcctcctgcttgtgaaagatacgactttgaatagtgaaagtcccaagaagggtaattcaagcaaaactggtttctagtttgccttgattcaaattctttatgctacttgacccatttctcttttcctcttgcttctcctgatgcctctcaaaataataataaaccaaccccagaaatagaatcctgtcttccttagatgtcaccatatgactaatttatggcctttgtttaaagcccttacaccagagttgactccagtaatttcctcctcttctatttgaatgtccatttacagcctctctgtaacctctgggtgaactgagaatgttctctgtgcctctcatgatgtggattcgcaccctggtgacagcagagtggctccgagcagaatctccccattacagctgaagcccactgggaccctacccaagttcacgtgtatatcccaagagagtttgctgaacactccttatgccttaatgcacctttgaaaaaaaaaagactaagggggctgggcgcagtggttcatgcctataatcccagcactttgggaggccaaggtggaaggttcacttgagcccaagatttcaagaccagactaggcaatatggcaagacctcatctctacaaaaataaaaataaatcagccaggcgtgggggcatgtgcctgtggttccagctgcttgggggtgctgaggcaggaagatcacctccctcagccttgggaggttgaggctgcatggagctgtgattgtgccactgcaatccagactgagcaacactgcaagactcccatctcgaaaaaaaaaaaaaaggcaaaaagatatcaaaggctgagtgggcaatttgaatgtgttcccaagacgtgatgggaattttctacgtttggattcaggggagtggggtcttagttttgctctcattcagggaggtgggtcccaaaaaatatcccctgttggccttaggaggaggaatacttgaaaggtatatctgaaaatgctccaagttttttcctgccccgctttccagtggtgcccttcgccaagtcatgaaaactctgccaacactgttctctctccagcactcacctgggctccccaccaatgtcttggctgccgtcacgactaaataatgccttctcttcttcccctccacccacccctctctggtctttagcacaacctatcagctgacttctccaactccagggagctagaccacatagtcctccaccaagagctttgctagcttagcaccccacagatagagctcgtccagagaattgtccaaccatccattaaaatatccaagtggccccagtgtgccagagactgctctctctggactagggctaggggtaagcagcaaaccaaacaggctaagacctctgccacctgcatagagcccatgcctactgtctgacccatccctacctctgcagatgctccttaattccccacttttactctctcctcttcagaaaatgatttcctccttttggatgaaaatttgattttttcgatgaagtgggacctatgttttctcagtttttatcttttttttttttttgagacagggtcttgctctgtcacccaggctggagtccagtggcacgatcatggctcactgcagcctcaatttcccaggctcaagcaatcctcccgccttagcctcttgagtagctgggactacaggcatgcgccatcacacccggctaattttgcttgattttttttttatagagacagggtctcactatgttgcccaggctggtctcgaactcctgggctcaagcaatcctcctgccttggcctcccaaagtgctgggatgacaggcgtgagcatacacgcctggccatggttttgatcttataaaataaattaactctaaggccgggtgtggtggctcacgcctgtcatcccaacactttgggaggctgaacggggtagatcatgaggtcaagagatcgagaccatcctggccaacatggtgaaaccccgtctctactaaaaccacaaaaaattacctgggcattagcctgtagtcccagctacttgggaggctgaggcaggaggatcgcttgaacccaggaggcagagactgcagtgagccaaaatcacaccactgcactccagcctggcgacagagtgagactccatctcaaaaataaaataaaataaaataactctaaataataaatggcaagaattttctttaattggcattttgtggggattcaccccaggcttggctgtgtgttatcatactctcttcactctgagaatctgaactgtctccctgaaggactgaagctagcctctgtatagtctaaatgctaaaactggctgtcagtttcctcaatgcttgccactgtgattttattctgaaagctacagctcttctcattcaaaggttaccctccctcctaaccaacccagaaagaactcactacccagctctgcttgcaccctagtgttggggctcaagcttccggttccgctaagactctgacctcgcttctaaggacacacacctcagaggcccagagctccgctgtatcacacactcattgtcacatccctcgatgcatcattcccagaatcctcaaggctgtcactggatgaaagaataaaacagcaaaacatccggcaccttttcatcctggctcaagtcaaaagagttgggattaaagccacttgtgactttcaaaagctatcactacgaggcaaggaccgagtggccagttcgtttcagaaagtggcctgatgctgttgaaactgccagctgccagtggacgtgagcctcactcccactttatagtctcaggaaggtggctctcaggacatgacgccaagccccagaagggcctctgaatcctccaccagcgtgtgcgtgtgtgtgtctgtgcgtgtgtgtgtgtgtgtgtgtgtgtgcgtgtgcgtgtgcgtgtctgcacgcgcacctgagtgcacatgggctgcctggtttacaggccaccacaacccttccaccaagtgtgaacacacatacacttccttaccaaggtgcccaccggaaacccctgcctggacccctgcagccctcccagccacactgcagcatcgagggaacagcactttgcctccccaaacctgccctggctactgggtgaccccgctctgctatccccaccttcaccctgagatgcacagactgtctgctctaaagggcatgaacctggagattgtgagtcatcacgacgcgcaggaagcaacgtctcagtccaaaccctgagcccgttcctagagagccttctccgctctctcacccctcatcccacgtagagcaatcagggctcacccgcccccttccctttctctatggcttcttcaagatctcctcatccatctgcccacaactggaactgtttatttgtttagcccactggtaagaaaaatgagagagcgggctggcattcctggctgggcataaacacgtttttaaaaaatgtctgttccaactctgtctgggtcccgtactgagccctttaacctcctgcaagcaccatggagacattccatgggaactatcaccattcgttatcatcgctgaaagacaaaatccactgtaccctgcaacatctcacacagatccttcacattcttggtttgagagctgactatgcaagaaaaaggaagcaccatgactgtgggaaaggccactgtcaccaggacaagaggcaccagcaagagccctgcatcaattactctacagaggcaccgggaggcctgattttaattttttaaaaatacatttaatgaatcacatacgcaaactttacattggcagaacactcccttaggatcatgagcaaatttctgatcagatcaaatagcaaactgcccaaggaaaccacgaagaggggtgatgttgctatcacactatcaaaaagtaaagacatacttctgatttctcacaagaaatttcccaacaaaagctctctgtcttagattccgaaagaaaaacatcccccacacagagtgtaagggccaagaatggcctcaccatatgggacagcttctgaaatacacagaaaacgggcaacgcgggacccatgggacaaaccactgtgtagccagctgccccggccaggcccgtggtgttgactttggcagtgcttgtcgaccatgactcagcaatagtcatcgaaactgaaatcaagtggaactgatcagttcagacctccaatgttgagtttgactcaacgattcttcaatgcccctggtcttcctgaaattctccatttaaatatttactggtttaagggtaaagtcagggaggcacgggcatggttgttggaccttttctgtcttatcctattcaaatctggctgaactgagtaaaacgttatgcagcaggatgtcttcctatataatccacttcatcccgcccccccaatactcttccataggggttcaaatgcagatctgaaccaactgctcgatgatcccccaaagccatttagtctctgagcttttctcatctacaaaatgagatgtgtccccactctgcataccgtatagagcacctgcaaggattagttgaaagggtataggcccaaggactttgaaaaatgaagctccttaaattattttcccgatgtcctcagacagacttggcaccttacccttttactcataattaaagatttgagcagctaactcagaggcctaattgtgatgctaagtagacatatagtggctcaataaaaggaaagactgaaggggtttagagcagcgaggaaagacaatcgaggaaacggggctcgaggttctgggacgagggcctgctgagctggccagcccagccaaggccacagggatacagtccttccagtcactcaagttaaaaatcttgcagtcacccttgactctatgtcctgtcttgtcccatatctcccttcaaaatctatccagaggataagcacctggagcagatcgaatagcatccctcctagaactcatgtctaccaagaacctcagaacatggccttatttggaaatagagtctttgaagtaatttataactaaattgagctcagactagatcggggtaggccttaaatcaatgactgagccaggtgtggtggctcacacctataataccatcactttgggaggctgaggtgggtagatcacctgaggtcaggagtttgagaccagcctggccaacatagtgaaaccctgtctctactaaaaatacaaaaattagccaggtgtggtggcgggcacctataatcccggctactcaggaggctgaggcaggagaatcacttgaacctgggaggtggaggttgcagtgagccaagatcatgccactgcactccagcctgggtgacaaagcgagactccatctcaaaaaaaaaaaaaaaaaaaaaaatcaatgactggtacccttagaagaggagggaacacacagaaatgcacacaaggaagacagccacgtgtagacgggaggcagaggctggagtgacacagctccaagctaaggaatgagtctttactcaaatgtcaccttctccgaaagcctttcttcactgtgtccaccgaacctgccaactactgctcaccccctgccctcgtcccgcctcctctccacagcatttaacatcatccaaaatactataatgcacttagtaatgatgtccagtgagggagatgaggtagtataagctccaagcagacaagcatttctctctttttttgcccccattggagtatcaccggcaccaacaacagtgtctggcacacatgggactctcaaacaaaaggtcaagggcagcccagggaagccccaaggctggaagctctcgctgagaaagccaggctgggagaagcccgtctccctgagtcaggcctgcaagccaggcaggcagatggtgaaaggcaggagggagaggagccactgcaggcccctggtcagcagaacaagaagaatacggagccgggagtttgagggcagcaccactgatattcaggctgtgtcattcttcgttggggatgagggtggctgtcctgggcatcgcaggatgtttaggagcatccctggcctctacactggatgccagtagcatcctctccccaaagtgtgacaaccaagaatgtctccagactgccaaatcttggggggaggaagcaaaatcaccccctacggagaaccgctgaaactgagtttcagtccaatgacggcccacatgccacgatcccagacagcacagggccaagcaggtaacacaaatgagcgaagttggctgggaaacaggacgtggtagggtaagagctggtaagcaacagtgagctctggcaacctaaaaagtagatgttccttccacaaggggcagtcaccaccctgttctagccaggttttgccctgaagacccaaaatggccaaatcccccgattttttttttcaagagaaggttttaatactgatttttctgtgaaatgtgcccatgtttaaaacatagtatgtggccaggtgcagtgtctcacgcctgtaatcccagcactctggaaggccgaggcgggcagatcacttgaggtcaggagttcgaggccaacctggccaacatggcaaaaccccatctctactaaaaataaaaaattagcctggcgtggtggcccatgcctatgattccagctactcaggagcctcaggcaggagaatcgcttgaacctcggaggcagaggctgcagtgagctgagatcgcactgctgcactccagcctggcgacagagcaagactctgtctcaagaataaataaataaataaaataaaatatagtatttgctgaacaaaacacatctacaggctaggttttgcctacaagctaagactgtgcaacctccgcacagagactgcctggaggtggaaggggctggagggaaaccccccttaggagcctgctgtcatctagacacaaggggcctggagcaggcctgtgagggtaaggggcggagggaggaaaggctggatcccagaaactcttaaggtgaataagataagcacagcaagacaagtgtgcacactgtaatcataagccacgagggccaaagcaacagccaatgcccccggctccctcccacgatgcgctacaggcagcactgtgcttacgcaggtcacacacctaggagccggaagacccctaatgcatccttcaggtaggaccctctgctttgcagaaaaccagcgcttagaaaaggcttaaagtgagtattttgaagacggctggaatcagagctcaaatccataacctcaaaggcttcatgtcatcttgccaccacccacgccaatccttgagcctagagtaacgaagagaaaggctgcaacgaccacacacaccacgacgtcagcccaaaggccacgtggctccatccacggcaacaaaatgcaagggagctccgagggacacttccgtttcaggacaggcttacggggaggacaccagctcctcccaccctatctgtagactgggtagaagggcttcttttgagcgctctgtcttcccagagaaggacgtcctggaaacaaggcacgtgcagtattaccattaaacaacatgcacatgccagtggcgctaaataaacagcagagacagaggctgcctcacccacttgctccatagtctgcatcgaatcaaggtcactggagacaaggtaaagtccacagagccccctcatctcacatccacacagctttgctcctcctgaaagaaatgaaatagctggagtgttttggcaaagaaacgaagaggcaggtgagcaaggagagatgggggaagggaggggcgaaagaagagaagaggcagccccatctcccagctggggagaaacttccagatgggaggcagcagacgccactgaattgatggccagtctccaccaagcctcatcatgccccgcaggcaaagtctccactccccttccttcccccagccacgggcaggaggcaccacccatgaagactgagtctgagatcatgcaccattgactacccaagcccaattcttcctgtccctgatctccaagtggtagctgcaaataagcccacgtgagttgcactgaaaggatcagggcactggttctcgaggactgggaatgcaatgataaaacgaaatctcaccagcactcagtaaagccagatccaatggcagccttgggctggtcacccctaaaccgccatgtgtcagtcgggttccgcctcccagaagcgggttaccctgatttgtgagctgattattctagaagactccagggtctgaaagtatctcaacaggttggctatgtaaaaacacagtcaatcaagcagccagacactttgcagagagactccactccacgaagaattacaggaggaccagagggtctggctgtgccggatcccacagctcagcggctacatgtcccccagaaggtgggcccaggaaggccctgcaccttgtatgggaagctctctactccccaacacaatacccctcggccttgactgccccttagacaccgcctgcctcctggagacgagacattcctcagccctctcccacatatgatctccgcatgtatccattataaggatctaacttttttatggagaggagaaagttcccacatgcagaagacttacaccgcagggggaacgaagggagggtcatttagcacttgttgaaagaagatgagtatgagagcaattgggaggagaagaaaatgtcatgtcagctatgaaagttaaacaggaacgttcccctccccacaacgaccgccctgcaccgccctgccccaagtccttcccaatgcggcggcagccaccagcccatgcaggactcacacatgggcagacacccaagttaagagagggggcccgggaaggggagggacaccatggtggtttgcagagctccacctctgggaatggatttgatgtcaagtgtcagcaagtaaattgctattggcttctcaataagcagcagcagtgagttaagtgtttccccgtattgtggagccctcacggactcgatacagcagtattgacagcacaatcacacagtaatccagggtcctctaatgcctacacttcctcaatgaaaatacactttccacttggacatcagcccattagctttgggctggaatctctggcctccttatccctcccccaggcacccctgggctgcaggtctggcatctggccccctgacaccccagccaacatgaacatcccagccagagtattgtcagggcccaaccgaaaaagataaacagtcagagacctacaggaaaaggcctgctctccctgtctataaatcactggtgggaaggaaagaaaagtgatccaactctttcaggataaaaatcacagcagtcactgaggaaaattgatgttcccttgcaaagcgaaagatgttctctccgggaagatgcatgccttcaagttttcagacagactgagactcaaacttcacccaatgtgacacaggattgagacaagttatgtgacctccacaaagctcaacctctcacgccagattcgatgcttcccaaaaggaacacacccatgtcttggcagtctccgataggctgaaatagtagagggtctgctgggcacagtggctcacgcttgtaatccgagcacttagggaagcagaggtgggtggatcccatgaggtcaggagttcgagaatagcctggccaacatggcaaaaccccatctctacaaaaaatacaaaaaaaaaaaaaaaaaaaaaaaaaaaaaagccaggtgtggtggcaggcgcctgtaatcccagcaacttgggagggaggctgaggcaggagaactgcttgaacccaggaggcggaggttgcagtgagccgagatcacaccactgcactccaggctggggggcagagcaagactctgtctcaaaaacaaaaacagaaaggccagtcatagtggctcacgcctgtaatcccaacactttgggaggccaaggcgggtggatcacctgaggttaggagttcgagaccagcctgaccaacatggtgaaaccctgtctctactaaatacaaaaaattagctaggcatggtggcaggcacctgtaatcccagctacttggaaggctgaggcaggagaactacttgaacctgggaggtggaggttgcagtgagccgagattgtgccatgccattgcactctagcccggcaacaagagcaaaactgcctcaaaaaaaaaaaaaaaaaaaaaacacatagtaaagggtctgctcatttaatagtaaacactttgcaaatgcaagctatgtttcaaaaccatttctcatccatttttatttgactcccagcacaccctggaatcgctgggggagaagattttattccagagaccagtgaaacacaggtaaaggagaactaacgtgacttacccaaggtcacacagctagttagcagtagatttggagctagagcctagactagggttggcaaacttttcccataaagagccatgtaactatttcaggccttgcaggccacgcattctcactgcaactactcacctacaccacatgatagcatgaaagtggtcacagacaaaacacaaacaagcaagtgctgctgtttgccaatgaacatttaggaacacaaatataaatgtcacatattgtcagatgtcccataatcgtattcatcttctgattctccaccagccatttacaaatgtaaaagccattcttggttggcaggccatgccaacatgtgttgggtcggaactggcccgcagactagagtttgccaatcccagattgctgggagacttctcaatatctactaatagaataccacaaagccaaaaaaagacaaaccgtgatcattcccaggcttattacaattttaactctccagtccagtcaaaattgcttgcctagcaaacaccaaacgtaacccaggctccaggtatctgacagcaatacagcttgcgcatgcaggcggggtgttcaaacttctctagaaaacaatgcctttttatgggaatgcctttttatgggaatttttgcacaaaatttcaagttaagaaactttccataaatacacaacgcatgctctagccacagctggtttcatatgctaactgcagaaggcatttccgaaagcagcatgtgaagagtcctccttaaatacagcgttagggaaaatgacaccctctatcctccccactgcccccaccaccaagaaggaatttgggtctgtgttcagtaagaagaaatctggccagaaaggggttaatgcccttccaggctgggatctgataaatggctgtgcagaaagcaggttccctcactttgagatatgatgtcactaacctttattgatccactatcagagaactttgcttatctctctcctgtgatatactgcccctcctgtgctcaactagtgtttaatacactgccgggtgccttgcactcctcatcgctcagcactgcagagagaggctgccacggggaccatatttcacagagccgggccttcccagcacagacgcctcccagagtcaaggggagccagcacccacctcccacctcctcccaggccgccaggtcccagctgcaccgagacagtgggtcgggtcagggcagggcaggataggacacggcccctccgggaccctgcggcttctcctttttttgggggagtgtggggacagagcttcagtcccaagattccccttttttccaccatgaagacaactgtcagccatgttcatgtgggaaaacataagcacctccgagtcagacctcctatttagagaaatgagcttcctgtttttccccttccaaggtctcaagacctcagtccaccgggaggtggaaaacaccatccatcaaggtgccggacagttgttcgggagaagtcctgccaggaagaaagccagagaacatgcccaggtgtggccaggcaggctcagatccccaagaagaacagggctccagagcccggggcagtgtgatgctggggctgccacacaccgggtttggggttggtcgctcctcctgccaacccacaggctaaggatgcatcaggcacagccttggccacacccaagggtggggagagccccaaagcaccaacagacaggggacgattgttagaactcaagacacagaattccatctccaataacctcaaccgctcggagggattctcaagctctgccaagacccccactggtggctctccaagaagcccatggtacaggctttgcttctccgggcccatccctgggaaagggggcagtgggccgcccagaaaaagtgagcaggggccctcccacagccccggggcacccaaaatttgcctaattgaacattaacaagttgctacaataaagttcctctgttgtgagcagggaaaccttttcggcaacaacaacagaagtcttgttacaaactgctctgaaagccaggcttcagcctcgacaggtgtgaacaagatttcaacacctcctacaatacaatgcaatccaaacaaaggggaaagtcaatcccagcctcctgaggtttctgcttgtctaacatcttcttcactcactcagcccaggggagccaagtgcaccttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaatttactggcagatcaatagagccggggttatattggcaaagtgtctacagctctattgactcacgcaatgcctcttatcaatttatcagaaatctggaagtcagaagatattgtttgaagggaaaagagaaaaaaaaaaagaagaagaaacaggaagcatgagtccagagctagagcagttagaaactagggtccccaatgaccaacttgctaccaagagtttcgtaccaatgtgtctcctgcaaagaaggctaatatgatacatttggagttaacctgcctcccttgcacgcccctctcagccttctcagggattccattttccataaaccttgtaccctggggagggggtgaatcctactgaagctggtctgggatttttgttttgtgttgtgtcttagcaaggagcaattccttccttaggttcagccatactcgtccaagttacagaagatccacacttctccaccccttgtgtggtttcctgctacctctccattctactgcagccagaattcctagccttggcttctttcttaccaatccataaaaagatttctttttaggtaaataggatatttatctcagcatcccaatactcccaagaggtcacaaggatctatcagactaacaatggcacttggtctcaagaagcgtaaagaaaacgaactcaagttctataaatcatcacaaatgttttcacaaataattaatcttcgtttgaaaatgttttgaaatatcccaggtagccgaccaaaaaagcctggcggcggggggggaagtaaacattcacacttcaccaaacccaaatgttcacaccagcgaaggaaggaaggacgcaggaaaacacgaagttcccgagtgtttctagccagtaactctagggggcaggtcggggaagaaagagagggtttggagcattccaggtatcaggaggccaaagggaaaagcgattttccttggtttggaggaaccacaacctgcttttgatgatccattttggtccctgcctcatacaacaaatttctgcttaattgctgttttgcatttcgtggagacatcgagtaaacagtacttaagtgtttccagacaaaaacaataactcactaatgactaaggcactgctaattaaaatgcccccatgatggcgtgactggactcagagccaccacagcaaacagaacgagctgggccttgaatgcatgaaccagaacgcgggcgtgcagggcggaagatcctctgctcctttctctgcaggtcaccacgggccctctggctgaaaagaaggcccactgtgacccttgctagaaggagagggcagaggtgtggagagaatgggaggagttagagtggggaaggggggtgaaggcactgagatttcagagggaaggcagcaccccaatagaatgcacattctagaaccttataagagtaagtggcctggcattgcctcaaaactttatgagctcctgagagcccctaaagaaaaaaaaaatgtgtcctactctagtagggagaaaataagaagatgtgttaaaactggccaaataggctgggcgcagtggctcacgcctgtaattgcagcactttgggatgccgaggagacagggagatcctgtctctacaaaaaattaaaaaattagccagacgtggtgatgcatgcctacagtccgagctactcgggttgcgggactgaggtgggaggatcgcttgagcccaggagatggaggttgtagtgaaccatgattgtatcactacactccagcctgggcgactgaacaagaccctgtctcaaaaaacacaaacaaaagcaaaacaaaaaaacaaaaacaaaaacctggctaaagaccctttcctagtgaccacagtcatacaaggcatccattcctaactacccttttaaaaagaagattcagaaagaacaaaaaaaccagaggtatactcgaccacctgcccagtgctaaaggatttctcaacgccatagtcagacttcacgagcgcatgcgacaaagtaacaggaacctagaaaacttctcttcgtccccaaaaagagaccaaaataactagccttccccagagcgggcagctttcctcttcagtgctcttcaactttcagtcctacagatgggggcctcccaacatcactttttaaagctcagcatttaaaaaaagaacaggaaaaaaaaaaagtagagacatcccagagtccacacgcttgcaaaggactttcttttcctcctcctccccccagcaggttaaagacctgctagttagcaacgagagcggatggaggacagtcattggaaccacaggggcctaatacccatttgtattcacactcagaccctttaagcatataaaaccggagaggttgaactgtttacattcacctaatgctccagtaaacaaatcagagccccagtggagggggtttcaggcagggctgcggccagaccccactgggtgccaggcagcaggagcaggatggggaaggaagaaggtagatgcatggaaaacagaagccaggctctcatcccaacccactcaagtttctccccaagcctgggccctccttgaccccacgcgacaggggagcagcccttccaggcctgagctccaccaccctccatggacaggtgacctcagctgccagacacctccttaccccctacccccagtaccctggagccctgccagcacccccacataacccaccaatgacctggagaggaggacagaagaggaacggccttgcaaagcacctggagaaaaaggggttaaatgcccagtgtctgactgagggagaaacttcccctcccttccaggcgcctccgagggttcgtcctcaactactattgttattcaagaactgcgtcttagctgagcagctcccccgccgccccccagcactgggtcttgacagaagtgaagcggggctgcctggtgtcccagcacagggcctgatcatatcctctaaaacgtgaacagtttcaacttgactggggggaaagggggcaggcggggggtggggggggactggcactccttttaaatgcagatttgaacttttcacccggggtcagacagctgcgatgctctgtccccagcagaggccagcgccggggccccttccacctcacactttcacagtttttttcctgcctgccaggaggccagcctgttaaaggaattcgatacctccctccctccaaacccaaatccacacccgcttctcagcttaccaggggcacaaatcccactggcatcctagaggagagcctcaaatcgtaggaggctggctgggtgctctgggaacagcaatggcaaaggaaaattgttgttgtcacatgtattgaccaaggaacgctaaggtcaacagtgagaagactccaggacttcccggccgctctgaaagcatctgaaagcagcatcttctctagggtacatttcacagtggcgctttctgctagaagccagcagacagttctccttgctatttcactgagaagagctgtaatggtaccaaggctgaaatcatttagttttgaaaagaagtcacttctgggtgaacaagaaaaactgtaacgaacttaaaaaaaaaaaaaagtctaggatgggactgcttgcctccattacacccctgattctcatggacaaggttgtttctgagttttccatgtcaccctctgtccctccatttctcctcctccaatgggagacgcccactggtcctcgactagggaaggtttccattccgcggcatcaagataaggcaagaaagcagaaatccaaataaacactaagagaagaaggcgaggggaagtttcttgctggaatcggtgaccctcccaacagtggcagctcctacaactctcatcttggggggcactagagcctctaagagaaagtcccctccaagcaatgcaccacacagtccctggactagccaaaccggaagcctgtgtgtgtggtgctagaaatgactgtgaagtcagaaaaaccacaccaattacctacaggtagaaggttctagattcatgccttcctcctgccccaaactagcaacccaccacggagagggtgaaacgagcatttctagaggctccctgcagccctgtctgtgatttcagtaatatacatgaagcagtaagtctgttgtaacaaacacactagcactcacaggaatgaatgagagtggggctgtcccctgaggaggtggcccgtgccttgctgccactgctggtcttctgcctctgggaaggttttcacagtcaggtgagcacccccacctgtacgccaggaagcagtttacagaacactggcaccccaatgtcacagttctatctcctaacaatctcatgagcatgtcgggggagccaggcatttctgaccaaacccgctgtgtgcagactgagcctgcacccattccccagtaaatgcaagcagctggtcacaggggtgatggctgacttggctccatcaacagaatgtctcagaagagcacagggcagcaatcttttattccagagctgcaccatccactaggtagccaccgacccttgtcactaccgagcctgtgacatgtggcttgtctcgatagagatgtgctgaaggtataaaaatacaggactccaaagatttggtacaaaaaaaagggatgtaaaatatctcattaatagttttattaatattgattacctgtggaaatgataaccttttggatatactgggctaaatgtattatgaaaattcattccacctgtttctcattgtttaatgtgactaatagaaaatctaaaattacctacgtggcttacactgtatttctactggatggtcctgtttcagaacctctgcctgtctttcaacttcagattcaggcgggattctaagtgttctcggatatgactgagacagacttctcttgtctgtcttgaacatctccctaaagctacaatgtactggctcccaaatgatacttttaaatgggctgaacaatcttagtatccaacaactcactgccaaactcaagtataaactaagaaaaaataaatcacttctgggacccacagcgtgcttttaaaaaataataataggccaggcattgtggctcacacctgtaatcctagcactttgggaggccgaggcaggtggatcacttgagctcaggagttcgagactagcctggccaacatggcaaaaccccgtctctactaaaaatacaaaacaaaacaaaaattagccgggcatggtggaaaaccagcccacgctggtagtcccagctactcgggaggctgaggcaggaggactacttgaacccaggaggaggaaggcacagtgagctgagattgtgccactggattccagcctgggagacagagtgagaccctgtctcaaaaacaaaataaaaataagtcatttactgtggtttaataccaggactacccacgaggcttgtccaaaagtaagccgtctcctactccagcctgatttcttactatcaagagaagacttctcccttttaactgcccttctgtaaaatatgcccagcaggggcctggtgtccaccttctcccccaccccatacacacataccacacagcacacgcgtgcgcgcgcatagacagactctctctctctctgtctctctctctctctacaactggggagggctgcgggaggaaggtgcaggcagcacagatgtggcccctttcctattagaaagtccctattctgccactagggatcacaaggccagtctcatttctctatgtaaatgaactttttagccacctcctcaaagaagaaaagctgcacagatgcggaaggccggtccagaggcacacaattacagccatttgcattcctccagcagccggattagcacaggaatgcgctctgccgctttgtggggggaaaaggagtttaggaagaaagggatgggtggggggatgtatttctccctggtctgtccacccaaagctctatgatacgcttccacttctgtgagagtcagaaagtggaaataactcctgctcagcttctaaagagggggaggttgaaaaggcgcagggaggaggagggaggtggaggtagagggtagaggaagaggaggggagaggggccggcaggagagagggaggagggggactgggtgtatcaggggaactgcccctcccggcgctttgatcccctcggtcggtcgctaggagaaaccaacttttctccttgggttaatcaaaaccaaattactcaggaatgtggcaggacaggtctgaacttccaggtccctttgtctttgaggatttaaaatgaaaaaaaataaaattgttaaagcagatggccgtggcctactcaagaggtgaagcgaagagtctgagggaagtcagaccacatctctcaccctccaaaaaaacacacccgcaaacttcctatgccaatttattgtgagagaagttatttttgtagacaacatccaaaaatcagaagaactgcccatttcatccttactgctgcgcaaataaaagaccctcaccccaccctcccatcaactataccttgtcaaagtacaaatacaagagaaccccagatttaagatacacccgtatatcacaacccgactattaaaagcggagtccaaactagctcaagaacatacgttttccaaacacaaagtttgggagtatttttcagtgtaaagttcttccttaggaatactggggtaaggaggtattcaaatatccggttgctattcaaatgcatccatgaaatttcatggttactgtaaaattctgcatctctttaagttctaagaaaagcggtttttagggaatgactcagaggagatatgaaatgtcccactgagtgacataagatcccactgctcatctgtcgtctagaaaaagcgaagaacctgccacccagggctgttctgtttactaggaaagtctgctgggtgtgctggccagcccggcgacagtttcaataagtcaagaggcaacaggaaaaagctgacctcagagatgaaagaaacctggggcttggagctatattaaggcctccacacctcctccccggctcacagctctggcaagcttgtggcactgtacaagatgggggcctgcacttcaggctcctggaaactctagaatgcaacaccctggcatgtgctatcattagggacagtaaaaagtgacacagcccagggcacccaggagcagaaatatgaacagcccttcgtgtgttataaaatgctgctatgcttcactgtaaaacctggctgacccccatgtcccccacccacccaaaaaagataaaataaacaaacagagcaccaccggttaagctatagagccaggattcaaaagataaagtgagaccaacacacagccatgactaccagcttgccataaatcgtaactggccccaggcatacggttatctgggaagctgcacaccaacttttaaaatactcttcaccttatctttaagcccagtcaaacacacacatacatcacccttcttagatctcggccattagtattccatttagactttccaaaacaaggtcatcccagagggtccttcccctctttccagtcacagctgtggactttcatccccttgtccaacaaaagggaccttgtacacaaaattaacctgaagcattagtctgtgtggtgcgagagtccacggggccctcgggatattgactcccccacccccccaactatccaggctcagcccaaaatcctgtctagagggcttccccactgtggaggctgggggagcttccctagagattagagaccctgccccttcagaatccgcttctcagctgcagctgtgcagccaaggaaggccttacctttcagagaataaacagaagaaaaaaacttcctccctgactcagtaacagtagaaaacgacctgacgtcatggctgcaaaggcccagaatcatctgagaactaagccatccaatatgacggccacaactgcacgcggcttctgagcactggacatggggctggttctgagcgttgagaccagaacatcatggtgaaatcgtgggttgctgaaaatatctgttttaaagttaattccacctgtttctttttactttttatgaatgactactaggaaatgtacaattacatataagcttgtactctctctctctctctctctattggacagcactagagaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaaggctggcctcgaacccctgggctcaaacctctgggctcaagagatcctcctgcctcagcctcttgagtggctgggactacaggcacatgccaccgagcctagctaattaaaaaaaaaaaaaaaaagtttgtagagacagggtctccctatgttgcccaggcaggtctcaagcccctgagctcaagcaatccgcctgcctctgcctcccaaagtgctgagattacaggcttgagccaccacacccagcccagattcttcatttttaaatgccaaaaagaccagtgtaaaattgagcaaacagcatcatctggtatcaggtggaatcacatacgcagaggctgctcaactcccaggctgcagtgaaggtgtctaaatggggggagtggccgggaacctgccattgttttagaccaggagaagcaaatgtaacctctatttcaggtgttcttaactggaggcgattttgcctccccaagggacagtgggcaattcctgcagacatttttgattgtcacatcaagggaagaaggtgctactggcatctagtggggagatgccagggatactaaatgtcctacaatgcacaaggtggcccactccccccaaaaacaattatccccaaacatcaacagtgccaacacacaaccaggaagtgaccaggcctgagatccacccaagtatctctttttttatttttttatttttagtagagatggagtttcaccacgttgcccaagctgatctcaaactcctgaggtcaggcaatcctgcctaggcctaccaaagtgctgggattacaggcatgagccaccatgcacaacccaagcaaatttttaatactcagatatccaggagcaggaggggacatccctttgcaaaatggcttctctccagagctcggaactggtcataagtttgagcggtataagcaatgtgaggaaatgaaaatactactaataatttaaaaactataatcgctttgtcgccagactgggttgagtgtcaagggttgattatgtctgggcagctctgtttttcaagctagtaggtaaacatggggcttaaaactcaaagcaacataaggcaggctcccccacaagcaagagtaggcctctaacagagagtctgaactgggggagtcactggcatgcccagttcaccatgcctgaccacacaggctaggcctgggtgcctgtgacaggcaacggagcagcaaaggagctgtgatggggcctgcaggtataggaaggggacagggcaagggacaggcgaggccaagacaggaagagcgtggtgctgaatgagaacagcccagccaggctgggaggccgagcaggagggggtagaggggaggcacatgataattaactctgcaagttgatagtatttgcatataaatgcctccacaaatcactacaaacaagccaggacaagtcaggcctattagcatacacaagccagccggggaaggcctctctaggtgggtcattgagtaggctgctcacttggagggccgcctgccagcctggggagggggacagaaggggagggctggggtggatgggggacactgtaactatttcagactctttcacttctgaacacggttgcaaagatgtcaaaaggagttggctctatttccaccccatggggaagaagagaattgctggaccttttagtttatttcttccaaggtggtaagaaacgaaaggtagcagaggccatcagtagcaaagaaagaaatgaaaagggcgtggagatggcagccaatatccggagaagcttttcagtatgtgaagtggtatgaagccctgattcctatttcatttacttcccactacaaatgtaaggtatgcattaggcccattttacagacgaaagaagtgaggcccaaagaggttaaattactggtccaaagtcacacagctcaggcctcaccagagggtgtaacactgatggcctcagcagagggtgtaaggcccatagcagaggaaagagcagaggccacctttccaaagagtgggcttttttgattcacctttgcttctcccattcactgttgagtccccatttgaaggggattcacaagcagtgctctggtcctcagccagaccctgccctgttttattctgtaattatttcctaccttcaaacaaacaatgaggaagaccacacctccctccagttacacatctgggagtccgcaccaggatttcctctgtcacccaatttttccactgtctggacaatttttatagtttcaccagcaagggcaaaatatattgacagtcctttcccacaaggtgtaaaagttctctgctttccccaaatatacctctggatttcctatctgttgaaggaaaaaccagcttcgactgcctccgttaaaaaagggtgtgcagggctgaggtgaccctactaccgtcatttctgccattctttacttgaacaacattttttaagtgggcaaaatactatcttatgaaaaacaaaccaacaggggcccaggtaacacacattcatatagtcagttacacagactgaaagtcttcatcaatgcccatctcaattacgttatcaaataacataaggggacactattcaagattccatcagaacagagatggcatttaaaagcagtcgcttgagtagtgacaccaacctcctgccgcacacactgaaatccatgagcctcttctaaagtgtccaaaagttgacctgacactttaacgctgatgcagatactccacaaaaaaaagcggagctgttaaaagggaagcagaaaccattcctccagtcaaggccaaatgtacattaagaaccaaggccttgagccaaagagcattttaggaagcagggccttaaatggtggaagaggcttgcattgcttcttgagtagttaagaacaattgtttaaaaaaagaaaaaagagaagttgggagatggagaagaaaggcacccatgtgttcttcagcaacttccacgggacaaagatgttgggaagggagaagtcatcagaaataggccactcaggagactggaagcatggggagcagctcagttcatgtctacacatatgtggtttttatagactttcaggagtttaaatgcttctgaaaagcgatgtttgcatactgaagggagacagacttccatatttgaacaggcacttatatgactttttcaggggatgcagggctgagatcaactatcagattaagccccttggtctttctgcactcggctaatctgcctcctgcctctccactaaggagattcaaatgagaagacagaggcagtcgcctctgaactagaatcttcctactgaaatgcagagcctatgatagaaatgggcaccggggaccatctatccaaaagccagcctaaccgatacactcagaagaatttttctccagtcacactcctggatggagtcaggaacaaccaagaaacaagcaaaactgttcttttgcctcctccttcctgaaagaaccccatcaagaagcctacacatgacccctccagtgtgtaagccccaatcatgcctaaccaccccaaatcaccccaagtactcagccctactcaataactaacaccctctcccatctacacagaacagcgggtataggcagtcactgactcctgccctagaagcatcgggcgaggggtctcactcccagatcaaaggtttgtggccaagataacttttgggacagtggatgaaatcagcagcagatgaaaactccacagcctttttcagagtccagtggagccagttctcccacttccagtccaagtctccctgcagatgactgaaggtgatccatacattcctaactgctgccccgaaagacccacttacaattaaactccaggtcaccagttaagaaagcctttaggccccttatgtcattagcttcctcccagaaaccaagcagaatagaaagtgagaggcatcccagcaccggcccatcttctcaaggtgtggccttgcaagggagtttcagtggcttcatcccaaaccaccagcagccaggagtaggggtgggagtgcggcagatgttttgcccgcctcactggaagctttagacctgactccagggagggaaaaggatggacaaatctcagaggcagcacatgtgttaataccaaagctcaaagaacacacagcagaaccacctaagacctccaggacacagcaagccagctaaggcccctctggaaaggtacacatcaaaccccccacacagtaatcctcatgttgagactgctgtggtgaccctctgatggacagggagagggggtcacccaaaaggcagatgaagcccaggcattttgctaagaggcccgggctggagttaaaaccaacaaaacagaagtcttgcttcaaaatggggctgaatttgccatctcgcaaactttctatgtctccctccctgtttttatttgagcccttattcttgtaaaagcaagaaactccatgaatgaaggctgaaaggcagaaacgtcaaagaaagaaaaaatcccctttaaatgttaaaagccaaagtactttccttgggcaaataactctctagagacacccccatcactgcctagaccacggccttgtcctcacccacctgtcccctggcccaaagaatgaaaaccagaaacattccagtcgtttccctacttctgaagcttcagctcagtgctgctgtcaatcggcactaagccttgctctgcacctctgtcctcagtttctgtccatatcaaagtcatttaccatattagcccaaagaagccctccaacatctgattgccactttgcacatgttcaaagagatcaatctggcagtcaactttaaatcatagagaaaagccctctgacagttgttgattttgtagtgcttctctttaatctggattttcaaagtggcttgccaatgagccaagatttctgcctgggtctctccctcggggcggtttgacacaaccgtagcttctgtgtgctcctttctcaatctgagtggcctgaggacacaggacactgtgctttggacagaacaggcgccctttatgatttaaactagctcctgccaaggaattcccttgcctagattctattaaaactgggttcccatttcccctgaccatagttttttaactcaggcagaggacggtggttctgagctgtgctgtgatttctaataataaccattaccaccaaattctcataccagagcatttggatacccctatgaggttcactgtaatggaatctgccttcctgttgtgtttttacagtaacgcccccatcctggttaattgcaccagccttaggaaccagagcaagccaacaggcccaaacatcacagaaataggccaggctaacagcaagcaatcattttaataacaaatgaaagcataaaccacagcacatactgtacttcttcaggttactgacaggcatcttcagtgtgcagtacgagtgagggtgagatggagtttatataagtttgttcagaccagaatcattgctgcctacttgtaagtcaaggctaaatccttagagctgagaaacaagtgagttactcttaaaaggtgagtgtttgtttgtttgtttgtttgtttgctttgagatggagtttcggagtttcgctcttgttgcccaggctagaatgcaatggcccaatctcagctcactgcaacctccccctcccagattcaagcgattctcctgcctcggcctcctgagtagctggagttacaggaatgcaccatcacactcggctaattttgtatttttagtagagacggggtttctccatgttgatcaggctggtctcgaactcccaacctcaagtgatctgcctgcctcagcctcccaaagtgctgggattacaggcatgagccaccatgcctggccaaaaggtgagttttataaagacagctcactttcttcccctttaaataattcaagccagttccctacacttttacaaaatgttgcttagtcacttaaatatttactttttaagatgacactgttacaactctgcaataaaaataatttcttaagtaagggtctgctctgagccctgaagcatttccagattcttactgatactttgtaggtggaagaaaaaaagctcctacccctgaaagatacaccaaaaaggaacaactgcacacagtgacaataaggacatgtttcctggatgctagaactaagccacatcaccactagccctagaaatacttttccagcagtctgtaatcacagatttattctaatgaactaaccacttttgggtcaccaaagatgagccaggccggtcctgggagtgtctagcaagcatcatttaaagtcataatgatgaaaactaaatctcgcttattttagctccttgccactgggctgtccaattggcactgagttgacacagcagttaaattcaacctcaaagcagcaagaaggcaggcacttcactgtcctggtgggaagagccaggcaggggcctgtggagggcaccgttttagatgggcctttccaaccctcccttaacattcatttgtgcaaacaaaaaatggaagaaaaggaaccaaaattaagtttcaggtggttggggaagcagcatggatttacattattattattattattattattattattattattattattattgaatagttagcaagtgtttctcaatagttccctgttcatcaacactgttttcaggagaaatggaaaacagtagctctatttcatagaaagtacagccatttcaaaaaaaaaaaaaaaagtgggggggggttgttgagagagggaagtgacccatgtcataaagacagaaggtctccaagtcacttaattccttgtgattctgaaagggctgtttttaaagtctaaaagtgctcgcttctgcatctgctccatgttgttaaataacacttgtgtaattaaataaaagagccaactgtgaccccagcccactctgagaggcactttacatgctttctgaaaactatgctggaaacaccatgaggagaactccttagtcctgtaatttagcaaagggagagagaaaaagtttcttttggccatcatagctacacactctctgaaagggtgcctgcagggtctctgcaaaacagaatgaacacaaatacaggcgtgcaaacatccaggtatgtacctctctgtgaagaccccattcttgaaacccttcaattatttggaaccgtggtctcctgacttccctcacacctcacttttgccttcattgtttttcatgtttgagtagcaagagggattcagaatctcaggctgccagtggctgttctgataacaaggagcagactcatgtttcttgctacggcctttcttgatcaggttaccttggaaggtgtatgttttcctacccaatgcagtccccaccacagcactctcgtgtcctcctccagcccagcctcctggaactcgtgattttcagggtttcccttgaaacctatccagaaaccacagccattaactgaacgtgaagatttgacacctcctgaattcaggaatgagggaactcgaggggccaactctacaaactcgcacctgctgcttgacggcaaggaaacagagtttccccagctagggtgagctttaaattatacactatttatttagtgacttgtctccaaggatctcaaagcatagagagaaataagatgatgtgtaactttctcacaatctaccttcaaggctttgccctggtgcattctgacaagcaggacccagtatgaaggagaggccttccttctgtgcccaggcagagccatctgttctctctggggttttctgtcagtggctttagggagtcttcaaggactgttaaatgacacagagggtggggggagggatgaccctcctggattcacctgctcacggctttcacttaagccagtttaacacaggaggtaccactgtgccacgcaattccctcttagcacacaccatgcgtgagctgcagtctttgccctccaggccttttcctatcataacacaggtgtgtccaaggcagaaaagaacattttccagaaggttcgtttccctccaagcctacaatgcttctttttgttgttattgtttttctgctactgacctaaacataggcattcctcctcctaacaggataaaaatcttgactctctcctttgcatcagctccccaccccgcccctgcccaaggaaataaatgctctgacttttccaagagtgcgaaaaaactaaaattagagggtggacaagatgatctccaaaggtgccctccagctccaaaactctgattctccctttaattactccacaagcgcattcttcacattgtttcgaactgaccagcgacttctccagggctgaaaagggtgcatttttaggcggaggcacccaaacttctaaatgacaccagtaccacaagtattcagaaggcaggaactaatccaaaagcagactcaggaaaggaggagggaggggaggacagagggaagggaaggaaggaggaaggaagagctttactgtgtgcccagcagaatttaggcgctctcaccctaggtaggtggcaactggagtctgggagttcaagtgcatccagcctgcccttcccccacacgccccaagagaatgggaagttcagccaagactcgcagcacctgcccgcggctccaggccggctgcgcggacccggagggaggctgcactcacctggcacaccaagcctccgcgcacctccggagggaggcggcacttgcaggtccgggggccgcgccgccatgcgcaacaacgggaaattccagtggcacccgagccccgagctcacccaccccaggcggcatgctccccacctcccgctggccccaggactcggaggtggctctggtcaggagcagggggcccggagacaggggaggggagctcatggtggcggcagggctggcggtcggcccgtccccggagggaggtccccgggacgcggcggggattcacccacggggcgcggcgctggcgtccgggtccccggcctgcccgccgccgccgcctcctcctctgccgccgcccgcccggaatcgctttatgtaaatgaagcccaactcgcagtttgcagcgcgcaccgcccggggaaggggggcgggcggggcggggggccttcggggatccacattacacagcaacaaagcggaaggttaatttgaaactcacagccccgctgccgctcggctccccgggcaaagcctgacatctacagtcgtgccgggcgcaggccgggttgctcggcggcgaccgcgcccgcccgcccgcagggacccggggacgcacagggacgcgcgg

SEQ ID NO: 2621 - DNA, 1426 bp, Homo sapiens
taagtttaagacagcctggtgaggcccagagcctcaccagtcccccagaaaacggagtattgtttccatccaaaccttgcactgaaaggagcctgtcagcaggaagtgacctcgtgagacaactgtggggagagcaaagggccggggagagaaaggcctcattctcactgcaaacaggaaaaggaaagagaaaaagcaagctctgtctccacacaaggtttgctgggctggctatgaactgttccagtacgttccatcaaatagacgccttcatagaatcaagccgagcgcgaacgccgtgtctggggctcccactcccgggacacacacgcgggctggcttacacatgctcttgctctctcgcgctctgggagagcgcttatatgggcttcatgaggctaagtaataaacactttgtcttcaccctgctatttatgggttgcttggggcatcctgtgctctccactgcccttacctgaacagacggctcatgcagacccggagtttaatagggacaacagtaaatctgagaggctgtgtgtgtcccacgcgctcctgttttcccagccacccatgctagttgcagagaaaagccaacctgtatcccttcgtttatgctctgtgtgcccttcctggaggtgaaatcccttctcctttttcttcgggcccttgttttcttccatcctttcaaacatctctctaacatatccttttgctatttgacccctcccagagatcccttcattcttcagcaatggatcaaagaactctgaaaacaagaacaaccccgacagctgcaaaccacgagccctcacctccagcagaggttttcgggaaactctggacgaccacgcgcatgcagaggtaagggaatgatccggtcctacctggcgttgacttccaggttcactcaaaggccacgtgccaccctttgcacatcgtgtttgggttgcaaaggggaaagatgcatattgaaagccagaagtgtgcccaggccaacagacgtctgaaagccacaggggacgaccctgaaaaagtctggcagatgcagaaccacagctgatcactttggtccgtttgagggcccctttcgctcagctcttttgggggttccagggctctcagagcttccaggtcctgtaagaagagatggagtcatagctgcgccctgtccactctcgggctgtcacacaagcctggagcccagccatttctcggccttgtcttcatcttgggctaaccggtcgtctcctgcaaacagacagcacggagaaggatgagtgaactcggcctctccccacagaatacagttcgccattacagcgctgattaaatacaggacattatctcaccataatgccctcctggcggcgttcccaggaaaattctaactaatcataaaaatagaaagaaaaacgcaacctaa

SEQ ID NO: 2622 - DNA, 34593 bp, Homo sapiens
tgtcatcactgaattctgatgggctacctggaactggcttagggtgggattacatacgcctcctgccacatcggatttccttctattttgtcaggggtggcatcatccagtgagtaaatctgttagtgatctccctcgcataacctaggaattctctcaggatccatttttccagtagttttgagaaagcgaccaacaacagcaaagagagtagttcttccattccaagagcagccatcttgcttaactgacaaactagagagaactgcaaggactcagtacatccctggcacagtccattctctctcacagcatattgtatgagactgtgtgagtgctgcttccacgctacactaaaaacccatggtccctgcattatttgagcaactgacaagcttctgaagttcaggttcgcgaacgctgagagcagcacccagtggatttgtggcaggtgagcagatccttctcatctcccattgtggaaatttcacatttcattctgctttgtgaatcccacaacttcatgacaagatagattaacattttgcaaaaaaaataacaaataatgttctgcttgagggaaaatcagacattaggcttcttataagaaacaaggggtcatgttgaagacttcaggataacatatcttggagaagaaaaagccattcagtggttcactccccaagtctgtggcagggtttttttgtttttttgttttttgttttaaaggttattttcataactttgagactacaattaatttctgtaaaacccacggaaaaatagcctcttttcaataatcttccccccatctttttccccaagagtctttaaatctgagaaaatttttcttttcaattaaaacaaaaaattgaacagatgtgcctcaagagggctggcagtacttttaagaactggtaataatttatttagaaccatgtatagtaatataatatatctttatacacaagtcgcacataaacacccactgcttttggtgtggtacttactgttccttgttggaacacccaggaaacttccatatgtcagagatcatgtatgacagtcctatcttctgtgtaaaaggtcatctcccagcagaagaatagctcgcctagttaaagggataccaatttttaaacgctctgccaagctgaagatggagagaatgagtgagagagggagatgtcagatttcaaatgcagggcacgctcattgtgccctcggatgctgagctgggaggagggggagagaaacctctatttagagatgattggaaaaaatcagtgccacacagtgcacttgagaagcaatgcggcaggctattcttgccctctccttggatgtgacaaaatggccaccatggaaacaggaagcagcagcaaatggctgccacaggtcttcttggatgcttgaggaagtgtctatgtgtatccaggcctgtgtggagtattcctagggtagcaggtttttaaagtcagggtgaagaaaagggaggcatttagaaggaatggacaattgacaaagaaagtggtcagacagcaccaaagggtaatgatctgggaaaatccaaggttccaagaaagtacgttgaccccaagaaacttagaatttacagtattttagccaccttgaaactatataaccatgccagctcaagtaaccaaaaatatcctagtccctgcactagccgcttttgaaatatcctgtttaaaatgaccccctcaccaccacgggtaagttgccaggggattggaggctccatggagggctatccctaagccaacctgccaggcaggcaggcaagtttctgccctccccaacctccccctgctagctcctttcctcctgagagtcgaagacttcctgatgttcctggttgcatcagacaccaatctggcccaacttccctattagaaggcctctgtgacaaccagccaatccgatgcaccaatctgagtaactgttttccctccttcaggacatggttacatttagttcgatcttttccttcccaaggcagatgcccaaagcaaaaagagtgaagcagtcagaatttcagacactgtgaacaactccccttggggtacctctggggctggcgtctttacatcacgacgacagaaagctggcccgcacagactatggccacggcgtcttagaggttttgtttctctgcaggcgtccagtgctctgtttctttccctcctcaccactctccaaaccacactcacacaaatacacgtccctatgtgcaaagacgcgcatatgtatattgtatatcagtgtgacactcacacatacgtgcggtgttagcatagcctttccccctcgagtccctgttgtgcttcccagcacccagcatcctccaaagcaggcagtggcacactatcactcataaactaaatccagccactgcctgctttgtaaataaagttttgctggaacacagacctgctgattcgtttgtgtatcgtctggctgcttttgcactagaacggggtggagtagccacaaaaaaagaccatgtggtctgaaatatttgctcactggcacattaagaaaatgtttgctgccctctagtctaaagcagcatcttatatctagaaaatctattccttaaaaattgtcaaaaggtctttctcttatcttaaaagtgattcataaacctgtacctcttagagtcatggagccatgtaattagaaggcgtattttagattgttagtcctacttatggcctagtacgtgattctcttctaggatacctgtggacgtctcatctctcttgatggttccagtaaaaggcaacacacagctgctcacagggaagctgtgatgtttcccaacagctctattggaaagttcttttttatccgcagtgaaaatctgatttcctatcatttccacccactggttcccattctgccctttggggccagtcaggaaaagggggacgatcctttttgaaaaatcggccaggcatggcagctagtgcctgtaatcccaacgctttgggaggcagaggcgggtggatcacttgaggtcaggagttcgagaccagcctggccaacacagtgaaacctcatctctactgaaaatacaaaaattagccaggtgtggtggcgcacgcctgtagtcctggctactcaggaggctaaggcaggagaatcacttgaacttgggaggcggatgttgcagtaagccgagattgcaccactgcactccagcctgggtgacagagcgagactctgtctcaaaaaaataaataaaaaataaaaaaataaagcatcaagtatctggaggtaactggcatgcctcacctttatattttgcttctccaggttaaaaaataacccgtccctctacctgttcctcaggtggtgtggtctcaaggccccaccacctctgtagcatctcttggtggttaatatccctcttaaacttagaaagccatgagtactgtgaagatatcaggtgctttctcaagatgagcattcattcctggtcaccatggtgctgagagttcaccagtgaagtgttagaagcttctggagggcaggagcagaggcttgctgctgtctttctggagcagcaggcacaggcacagggtagccccatcatctcatcgggtcccaagatgccctctgaagctggatatgccaagctttgcaccggtggctggaggcctagcggggattccaccggaaatctggttctagagaatggtatattttgaattaaccactcaacaaatcataaagcaggattgtcagactcattacgggaaaagctgcactgaaaataatgccttaagtatgtgttgttgctgctggggatacaatcggtattagtggcttaaggggctcaggaaatttccatgagaccgtaacaaaggaacagccagcatttggtgggaacaatggaggatggacccttttctttcatcaatgaaaggagatctttcttattatttaaaaatttgcttctccaaacacccacttctccccctggtgtaccatgtcagagttactgaggaggttttaaaaaaaatcattaaacaacccccccaaaagagggctcaatgaggtctcattccgtggtaatgagctccaatttaacgccatcattatttctgacattaaaggcccgagaatagtgtcacatgcccagaagctatttttttttttttaaaccagctaatcccagaaataagaaactgccatgagggacagtgagtcagggcctgtaaaagtgctttaggagaggactgtggcaatagactgacctgagcgtgggaggcacagcctgcacaaggcccttagccaccttgggcggacaggcccagcttgtgcagtgactgtccagtgagtcattaagaccctaggttttggccagacgcggtggctcatgcctgtaattccagcactttgggaggccaaggcatgcagatgagttcaagactagcctggccaacatggtgaaaccccgtgtctactaaaaattagccagccatggtgatggacacctgtaatcccagctactcaggaggctcaggcagaactgcttgaacccaggaggcagaggttgcagtgagccaaggtcatgccactgcactccagtctggttgacagagtaaaactctgtctcaaaaaaaaaaaataagtctaggctttgtgttagattctaagtttgaggcttagctgtgctgcttgtgccaaaaccttatgactttagggaattttacttaagttcctcatgccttggtttggctcatctgtaaaatggaacccataatagtacctactaccaggtggaggcaaaattaaataggatgcagaacacagactctaacatatcaaagagaagaaaggaacctacaggatgatggacagggagggacatctggaagcaacagctgggctccaggcttagagatcaaccagtgccaaggggggcagatcagaaggctctagaagaactttcataagaagacaaaattagtagaatgcccaatatatctggatacattgagagatgatgcacacaaccggggaagacttcaggtatatgtcaatgacagaagactaagaaaagcaaaaacagaaccactgaaaacagagtcatttgggaaaagaagagtaaacagaatatactacatggctcagctaggctaaatattgatctgataaaaatgacaatatcacgatattggcaagatgggaattttatgagggttttttgaaggggaatttaaaagagagctgggccctcatttttcacagtgggaagtcagtagataatgcctagaaataaaaatcaagaaacagcagcaaggccaggcgcagtggctcatggctgtaatcccagcactttgggaggctgaggtgggtggttcacttgaggtcaggagttcaataccagcctggccaacatggtaaaaccccatctctacccaaaaacacaaaaatcagctgggtgtggtggggtgtgcctatagccccagctactcaggaggctgaggcacgggacccttgaaccctggaggtggaggctgcagtaagctgagatcacaccactgtactccagcctgggtgacagaatgagaccctgtctcaaaaaaaaaaaaaaaaaaaaaaaaagagtgaaaaagagaaatagcaacaaaagcattttattgagagatatggaggtaaagttctaaggaatcagtttaaagcactaaaagagtttatccataagggagtaggagctagataggggattttgggggagaaattatatatatttttgcaacaagctggaaggactatataaatctaaaaactgtgtatgtaagtaactttgataacagtaaaactaaataaaattcctattgaaatggaccccatcaattgatttcaccacgagttcctctggatttattaggattaagaccagatttagcagtttctctgttggctgtctcaaccttctaacagatgaaacgtcgaataaggcaggtcaagagcatttccagaagtgtatctttgttttttgtttttttgttttttgagacagtctcactctgttgcccaggctggagtgcagtggcctgatctctgctcaatgcaaactccacttctcaggttcaagtcattctcccgcctcagcctcctgagtagctgggattacaggcacctgccatgacccccagctaatttttgtatttttagtagagatggggtttcaccacattggccaggctggtcttgaacgcctgacctcaggtgacctgcccaccttggcttcccaaagtgctggggttacaggtatgagccaccatgcctggccaggaaagaagtttcattggctcacagctcagcatggctggctgggctcaagcaatccttccatctcagcctccccaaatgttgggattacagatgggagccattgtacccggcccttccttccaatttaagctgaatatttctttggtcaaatcagtatgttgcttgtcagtacattcttgtcagtctcaatgggctgatgactgggcccatgacatcccccatgatcactgacagtattttaccgttcctgatactgcagttcctggtcctcccctttcctccatacaaatgttacattcagtactcccaatctagacagtcgttcatatgctagttcctttgagatcaaaattatgaactcagatttgaagcagagatgagcacataacaaaggtatttgcgctgttcacaacttcaaagtcgctggcgagaaaatcaagttgctactggacgtatgcattccttctcacgtgaatcttccttctgatgctgtgtgctgtttcctagctctgatcacattgaataaactatgaaagttgggacctaatctccaaaacgagaggacaatggttcctgcaggaaaacacattctcttgggagtcaccatagtatccagtgggtaaaagcactgtttcaaaaggaaaaatgctagaaaacactgaagtgttcaattaagaacattaattctttagtggttttctacctgtatgccaacactacagatatcctattatatatatatatatctcatgtatatcatatatgtgatatatatgaatatatgatatatataagatatatataaaatatgtattatatattataaagtatatatatcatatatatcatatatgtgatatatgtatacatatatctgtatgaatctaaaaactgtgtatataagtaactttgataacagtaaaactaaataaaattcctatcgaaatggatcccatcaattgatttcaccaccagttcctctgatttattaggattaagaccagatttagcagtttctctgttggctgtctcaaccttctaacagataaaacgtcgaataaggcaggttaagagcgtttccagaagtgtatctttgttttctgttttttttttttttgagacagtctctgtctcatatctgatacatatttgatatatatatacatatttttctttttgagacagagtcttgctctgttgtccaggctggagtgcagtggtgcgatcttggcccactgcaacctccacctcctggttcaactgatttttgtgcctcatcctcccaagtagctaagattacaggtgccccctaccacgcccagctaattttttgtattttcagtagagatggggtatcatcatgttgaccaggctgcatttgaactcttagccacaagtgatccgcctgcctcggcctcccaaagtgctgggattacaggtgtgagccactgcacccagccctatttaatattttgaaataatactttacatgaacagagacagaaggacaaagatatgcttgtaatggtacagaaaaccctactgaaattataaaaactggtatggtaaataacttcctagattttatattaattgaggctttgacatggtcccaaagtaaattgaactctgtaccccttagataacattttcagtgtacttctatgtgccagacactgacctaagcatcttacatataccatattatgtgacattcttattaactcatttggcagataaggaaaccaaggcccagaagggtaaagacatttgccttgggattgaaagttcacattagtaaagccaggacttgaacccagctgtcatcccaaagaccatgctctttatcactagagcagtggttttcaataaggagtggttttgccccatagagaacatttggcaatatctggagacattttcagtggccatgcctggggctaggagtgcatctggaatccagggtagtctctagaggggagatgtcagggataatgccaaacatactacaatgcacaggacaccctcacaaaaaaggatcatctgggctgagcacagtggctcatgcctgtaatcccagcactttgggaggccgaggcaggtggatcacctctgtcaggagtttgagatgagcctggccaacatggagaaaccctgtctctactaaaaatacaaaaattagccaggtgtggaggcgcttgcctgtagtcccagctactcaggaggctgaggtaggagaatcacttgaacctgggaggcagaggttgcagtgagccgagatcacaccactgcactctagcctgggtgacaaagtgaggatctgtctccaaaaacacccccaaaaaccaatcatctggcccccatgccaagagggtcaccctgcaccgtgctctgcttgtttttctttaagaaattctgaactaattgcccattatcctgtccacagcatctagagttgtagctggcacatagtaggctgttgtctcctaactattagcaaatggattatttttctgaaattattaaagcccctatatggctacataaaaagacaccaattgtttttctttcataagtgattatgtgcctaatactttaaaaaggcctatagacttgaacctcaccacaggtgcttggaacaggggccctgatgtgtaaaactccccagggatggtatacaagtcccacgaatagaccctaattacttaccttaagtgcagatatataagacatctaccaatttgtttccccacacaccagttgtcccacaggactttgttaagtatgcttatatgtacatcttagagttatacttttaacaaggtttagaagaaaacaatgcttactatacacttcttgggttttcttttccctttgttattccataatcatcaccctacctggaataaataggccagggccttagaggaatgtagcaattctgttgaagttatgggaaagtggctgaaggacctaaatggaagatggggagttagaaaatggaaagacacaatattccctgttagcctcccggcgggcatctttctccactcctttctagtttgtatgatgggaagaggcttatgcggaggagaggacagagaattaggtcacacccatgataactgaagattggcttatttatgaatatcttgcacggtgcaagtataccatgtaggctcaaactggagaaggctgtattttaccctcctaacctccttctgcagctttaatgaaagttttcaaaggggaattgacatgtttaattgttaactagaagactcatttattttttttcattcattcattcaacacatactaagtgtgttagtctgttttcacactgctatgaagaactgcctgagactgggtaatttataaaggaaagagatttaactgactcacagttctacaaggctggaaaggaaacttacaatcatggcagaaggcaaaggggaagcaagtacatcttatatggcagcaggagagagagagacagaagggggaagtgtgccagactcttatcaaacaaccagatcttgtgagaactccctcactatcaagagaacagcatgggggaaaccaccaccatgatccaatcacctcccaccaggtccctccctcgacatgtaggggttacaattaaagatgagagttgggtggggacacagggccaaaccatatcactaagcaccagggtatcctcctgagtacacagatggcctacatttcctaacctcatttgtggtgaggtgtggccatgtggatgagttcttaccagcacagatgagcctaagtgacgccaactacttctccgcccagaccttaacactgatcctgtaggtggtggcaatgccccctgcagtgtggaagcagcataaggaaataaacctaagcggctctcttgtgagcaagaaattcacttctttgcttatccagctgctctatttggggacatctttgtcatagcctttgttacttacatggatgtctaatagcagtctatgcactcatggagttcataatctagacagacagtaaataccaaagataatcagggaggcctctctgaggaggtgacatttatgatgagacctgaagagtaaggattatcagccatgcaaagatctgggcgctcaggcagacagcaaaacaaatgcaaaggcagaaattaacttgtgtctgaggaatagaagagtggcatgactggaaggcagtgatggggtcagagggtcactgggtgaggttgagaggaggcagaggaagagtaagtggaggcagttctaagtgtgatgtgaagccactagggtgttttaaagtgggtataggcatgggtgtgtagagagagagggagagaaggaaagagatagtatttgatttgcatactgaagatcacctttggcgatggcatagaaaacagactgcaaggatcaagaatagaaatgagaaaagcgaagacagaatggcagtggttcagtgagcagtgatggtggcttggaccaggctattagcagtggggatgtgggaaagggctggattcagggatgcgtttggagagaaagtcaatggatctgactgacagattggaagtggagggtgaaaaacagttcttatcttgagcaggtgggcagtggtggtatttgttaagctgggcaagactttggggggtcttggaaatgggggggacatcaagaggcctgttttgttttcgcttttgtttcttttggagatggagtctccctctgccacccaggctggagtgcaatggcgcaatcttggctcactgcaacctctgcctcccaggttcaagtgatccttctgcctcagcctcctgagtagctgggattacaggtgtcggccaccatgcccggctaatttttatatttttagtaaagatggggtttcaccacgctggccaggcttgacttgaactcctgccctcaggtgatccacccacctaggcctcccatagtgctgggattacaggcgtgagccactgcacccagccaagaggtctgttttaaaagtgctaagcttgagatgcctgttagaggttgacatggagagtcgggggttcaggagagattactgaggagtcttcggcaaatcaacagaatttaaagccacagacctagatgtgtcctcttagggaaagggaaatgggagaaaaagaggagaagaccagggaaaaagtgtctagcagacatttaggcatcttctcaccagtgtctaggataaacaacacatcagcatttctagggaagtggggaagagcccgcactgttggtaattccaactggcaccatgagaatttctgtgagtgctggtgccggcctgcactggctcatgatagctgtttgttaaattttcaggagttgtgtgagccagttattaaatacagctattattgtggaagtcagggtggagcatttataacacagaaaccagcaaattatccataggaggatctctaaaaatttttgagagcctatctgtaagcacaccactggtccccacataatttgtgtccagacttatcagagaaatggcatgggatccccagatgccatctgactcatttcttacataagccgacccataagcacatcatttgtagtagatgatggcatgatcccattgtctgggaactcctataacactgtgacctccatccactgttgctctcttgccagcacaagtacacttataagtggcagtggttttttttgttttgttttgtttttttgagatggagtctcactcagttgcccaggctggagtgcagtggcacaatctcagctcagtgcaacctctgcctcctgggttcaagcaattctcctgtctcagcctcccaagtagctgggactacaggcatgcaccaccatgccccccgctaattttttttttttttttgtatttttagtagaatcggggtttcgccatgttggccaggccagtctcgaactcctgacctcaggtgatccagttgtcttggcctcccaaagtgctaagattacaggcctgagccactgtgcccggctggcagtggatcttaagcagccctacaaaaatgttaaagggaagggatgggaacctgagtatctggatttttgtggaattaatttttagaaaggtagaatattctctatactaaacaatagtcacaaacgatatgggaacttggggagttcctttcctctgaggcatgggtggaaacactgaggtaaatactttgccccatgaaagaaagcagaggggactccggtttcctggatattcgagacatctctccaaccttggggacacgcagcaccccatgatagcaagtttgttttttataatccttctttttcctccactcagtcttggtattctctctaccacacctatttcattgactctaagatgcgttttcacaaaggtgcaaatgggttgatgagtttattcaggagtattgacatgctacggtgcactggagcatgcagccaatctccctgcacgcttgagtgggccgtggttacctccactgcctccaacaggaatcgagtgctgttttgtctccatgctgggggactggagagatgtgtcattccagcatcaccctaattatgattttcagaagatgtagctgtctggatataacagggccatcaaaagtgtgtggaaagagtgtgtgtgtggtgtgtggagtgtggtgtgtggtgtgtgtgtgtgtgtgtgtgtgtgtgtctagatagcagagggtacacccccagaggctgggcttaagaatgaaatggagttattgcattactgcctgtgcaaagctaagcctgcatgcacagtaacagacgtactgacataggtgctcacacgcatatgtacaaaacccacgagctatcctgagcgaggcttttctttagagatgaatttagtgaatcagagaatgtcaaatctgtaaaaaaaaaaaaaaaaatcaccaaggttatcccacccaaagctttgttgttgttgttgtttcagatgaggaaactgaggcccagagaggttaagtgattgccctgaagccacacagctaaccagagaagatataagttcctgccttccttacttcccattctcataagcaagtttccgcatgaacaaggtggcaggtctgagcaaaatgctaaaactgtggccccattttgtttgtgcacatgtatgtgtgtacatgagctattggtgtgacgggagtttgcggggatattctctccctgttacatgttttcacatttcccacaagacgggaatgaaaaggaaggaagagctgaaccattccctcaggcaagtagatctgtggcaaacaaagagtccacagctcggtctccacgggggtcagtctgacttccttccctcagaagcatcccgggctacattttcatcttcgccgtcttccaatcttgcataatctataataatgtgattccaaatgcattttagcaaatgcaagatggaatgggactcccccggctgctcccgaacatctgatctaagaaacccgtaaggagctgcagtgaaaagttcactgatagaaaaaaacaaacaaacaaacagacatttgcctgtgtccctggttaggggcaaggcttttccgggttggtggctcttggtcatctttgttgtccttaaaaaagggataacgctgaggagctggcggttcacctttgctcttgtgtttaattgctgcaaaagccacttattaccttgtgttcttccgcagagggcacactgtctttcccagccaccaggcctgctggtgtttggcttctctacctgccccggaagccatccccgtcacctccgagtaattctgggtcacttccagggccaggtctgtctggctccggtacaggaaggccctcatgaaaggaagaagggcggaactgggatttttttttctttctttgaattttgcataaaattccgtccccagccacctaatgagaaaacatccatcatctatctttccctgggaatgtcggtggccattctgagctggtttgtggtcccgctcatctgtacgcaggcagggcttgtgaaattgcttttccctcagaaaaatatgttcatttccaccttcctcagatggccctcacaaatgaaagtgctttgtcatttttaatgcccagtgttccctttttcccgcactgtctccagtcacgatccagccgataaaacccacaggtacatttaaaacaaaaaacaaaaaacaaaacacacacacacacacacacacacacacacacacacctcaaaagcccagaggactgtcagattccactggtgtccccttgtgggttttcctggcacacagagcaaaaatggctgcaaggggaggttctctctctgttccctggaaatctccttgggccttgtgcagcatttggatggacacgcagcgacaggggacgtgctgaattctagataacagatgcctgccttaaaatggaggcacaaagcccagccctgtccccttggctggccggctctgagcatcctgagaattaacagaggtacatgtgctttataaaaactggaaagtgtactaaaaattcaaagttattattatttctaaaatgtctccagcctacgatttgtcataaacacctatcattctgcatagataattgggtaattgttcctcatgccagagggaacaaacgtctctctttgaaatgtgtgtggaggcttacacatagagagccctgttataacgagggtctgactccatagagatttgtagatgccaaaagactaacaataacctcctccaaaaaataactgcatccagcttttcataggcaagttagtaggaccacctgattccagcattttaaaagagtcaccctctatatggaaatgtggtcaaaatactagtccaggaaaggaacatgacagatttgttggccaaaacttatttcaaagcagaatctttgtaaaatatgatttttttcccacatatctgcatttcaagactgggttatctttgtttctttgtgattgttatttaaatacatattagttttaacttttcctaccttttcttgatcacaccatccgctgagttaaggatctgtaaacaaagcttgaattgagccaaaatgatctaacttccaaagggaacccttgtttcctcaggtaaacttgaacgtcttcattgatgatagagaaccttgcttctcaaataacctagcatgaagggcaacttggtagttgtttttgttgctaatatccaattccccatggcctgatacttttgtaaaatacataacagttgaattactagaaaaataaaatgtcgcttgaatgttgcagtcatgtcatatggctacaaaagtctttaaactcttaactctgaatttctctacttaacttgttgagaatccctgtcaaatggttaacagaccaggaacgacctgtggacccgctttgagtagcactgaggttgagacagctgtcctgccatcttacccacggtggctcattttccagctatgaaactgctcactccttaacttataagagtttgtcaatccaatgttttaataccttttttaaagcagggacaggtctgtatacaaagcctgcaagctaagtaatcagttgataactgagagggagggctgttaatgtcaatatgagttacacaaagcattgtccaagaataaatcaggaagttaccctaaggtacggcagagggaggggagggcttgggggtggctgtcgtacatatggaaaataaaaaaaaaaacattacagagaagtaattcttaacctgtattccataagacagtagattaagaggtaatagagagagctaacaccaggctggactaaagaactggaagcagagaacatacacaacagtgtaaataggcacacacacgtgtgtgcatgtgtacacgtgtgcatgtgtgtgcatgtgtgtgcacgtgtgggcgcacggtccacctggtgggctggctgattggaactgagtaaggaagggtggaaaaaaggttgagggagcattttcagaaagggggtccaatttatatccgttgcagtaattggtttgtttgtgtggagcaggaagaaggggcagtgggggacgtgatggagtgaaacaccgagggctgcgattcccctgcttgatgagttggagagaaattgttagtaaccaagactggtcccgcaggggttcgttaagtgactggccctccaccatatcctgtcatttccaacctggatgcatcaacattagcccgctttgcggtatgcaattgtgcatctgcacgggtgtgtgaaggcgcaggagcgtctgcgggccgggtctgtgtgcacgtttgtaccttttcttgtggatacagttaagttttccatgggaattagaatcatgaaggccacatgcaatttttttttaaaggcaaaaagcaaaaggtgctttcttactggaaacacaaatttgctgtgacacttcaaaagtaccgtggagttgaacaataggaaaactaagaaagggtctgaactgggcgggctggagggagctgagcactgaaaggctggccggtggcgaacacatccaaatggtaacttcttaagtcagccctgaaagggacagtgagcagtgtttgtctccggattgtgaggcctgtcaacccctgggagacaggggcccagaaactggagttcaggccaagagccaggaaggaaggatcggcaaatttgccaaatgtgcagactgcccacaatgtctgggtgctggtggcatttggagtcacggatgctctgtctttggatcttgggattttttttttccaggcgaaaatggaagaaagactcctgtggggaattttaagggtaggagtccctttgggaaccccataaattcagatcttagaaaagcactgaggaaaaaaaccaaaaatgctttttgcaccagtgggaactctgaggattcagtctcctaagtgctctgcctgtctgggttagccaaggatccagtttcaggggctgggggaaagctaatgccatctaaaggaggccagcccctcccaccccctcaacccacttagctcagtcctggacaaggctggactgtagcctctggacagaggatccccttaaggcacagaagagggctggacttcaacctctattctgtggtttgtaatggtttcctggaatgaacaatcaaaatgtaaaacctgcaagacatgaaagtgaccatctttgagtgctttttctacttcctaaaacagggatgcactctatctgcgcagaggaaaactcgtaggacctcctaggatgcatcttggctccaagttcgtgcagtgttattaggaaattacaagtctaagcagccgcaaagagaccgttaaatcacatcacctgcaggtttgcaaatatatgaagataggcagagctaattgccattattgttgttggtatcattattgttaatagatgccatctgttgatacttcacatcttatacatgtctcattttcatcttcattataagcatgtaacagaaaaaggcaagtactattattatccccgttttacgcataaggacaccaagtctctgagttcaggatgtccccgcgagcccagaccacctgagtccacagccatgctcttagcagcttgttttgctacccctccaagtcctgttaccatttcctaagtgtttcccaggtggaaggcccattcgaagcactttacatacattatctaattatctcatttggtcctcagagccacaaatcaagctaagcagactgcccaacctccaagcacttatgagcttgttgttcccacggagtcacatcatccttagaccatttgcaacggtccaaggtggcagagaaatcacttctgggcatgaatgtggtcattaccaatggccgtgatgggacctggggctgttgctcttcaaggctgatatgagcctctagataactcaggaaggaaacttttaatcctcatcattacaaccatcagtgttgttctgagcatcagcgaccaaagccggaaaggaaataaagaaggactttgagagtcatgtgtgttttgcaatgaaccaaaggcaaatggggctttcctgaattttttaaatttaggggccagaatggaaattattctgtttttttccacatctaccaagaaggactaaggcttagctgtactactttctacgatcctggctgatttttctttttcagtagaataacataaaaaaggaaggccagggtgctctccaaacagaacccagatctaatgaggggattttggagttgtttatatagcatgtctccttatctgtataaagcaaagaacatctccaggtattttcagtggattgatctcatcaagacacagatttattaaaaagaaacacagatagagggaaacaggccactgtaatttatacattagtttttttgttttttgttttttttttttaagaaataaaaactaactccaagttttttagtcattgcaatggggccctgcacatcacgtatgtaatgtaatgacagcttcagactagggatgcttttgatgcattattaaccataaaaaagacattaaataccaggctggaatgccatggggatgcatatttcactaggaattatttttcaatgtatgcttaaagtttattttggtaaacagatgactggaggctgtcagagccggagtaagatttatgttcatttggaatcttcttgaaaggagcggaaatgcctgggacttgtggaacacccacagcaaaatgtaaatcttttcttggccccagggaaggttggagagtgccacacaaacaattcctcctagggatgtgtggtttccaagcagcatcagcgtagatgcccgtaggggcacacgccgggtagagggaacacacattctatcgtctctaggaggagggagcagaacaaaaacatctggactgggaagccggcctcaggatgccccatcagatgcctgcgcatcagctgcaaagaacgccccgaactaattcctccgtttcacagtcacccccatgttggcaccaggagctgtttccttctgtgctgacacatttgtaaagcatttctggttgtggacgtagaacttattgaccatgtgggttttcctatcctttgtaaatgatggaggcatcactgcatccatctacaaagcccttccttggagcttctacagccccaggaaccgtcacagagttacagtcgaggcaggaccaatgggtacctttctgaaactgaagacaatttcagatgatcacagtgtgcacctttagggcctgcttctgcttctttactatttgatacttagtaagtttcatcctaaagacatacccattttggcagatactgacagcttcgcgtagctgctccaggctcaacaattcgtatggaatgctataaattctgtttaacatttgttacatagatacttagctacagattcagagccagatgggcacacctaacccatatgcatctgtaaaatactctcctgcccaaatcctgcctgtatctggaacactctgagtgctcagaagatgttactacaattttagggccgaaggatggtctatttcaggtcaatgatctgtgatttgcactaacagggtattagtggcatgaagatgtctgcaaaagaacagaaagaaagagttgggaatgtattttctttttgcagccttatcatcttgagctttggctggggctggtttatattatctggcgacattcccatttttaaatatggcactgaattagcctaggcactcatgtttcagtttcttagagtaacaattaattgaatcaaggttttggtgatgccctcctccaagggtggctgattctgtagcagcagttctcaaaagaaagggtgattttttcctgcagggcgtatttggcaatgtttacatatatttttggttgttacaacttgggagtgctagagatactcagtgggtggaggccaaggatgctgctaaacattctacactgcacaggacctccctacctccagccaccacggagaatgatccagcctcaaatgccagtcgtgcagaggttagaagccttgttctaagggactgtaaatgcggccgctatgctttgtgactaaaagtagctggaatgacagttcggctgtgtacaatccaaaaccgattgcattggaaaatgagggaagggcctgaatgctggttttccactgaatggtggttcaccccttgggtcctttgttccatggcctgtggtatgatatcatcaatgctctgagacccacacagcttggcagaggacacatcagtagtccaagaaggtgtcactgtgctcattccatggttggagaaatggaggtacagtacagttcaatgacttgcaagagaccacagcatgagggagtggcagggtcaggaacagaccactgagctttccacctttagtctcccacctcctaggctggtgttagaaccaggagatcacactgaacacacacactcgctccctcccttcctctcctgcatatagagatatagcaaatgcaggttaagttgactttaatctttaattcatacacaaggatgtgcagcacagagtgaaataaagagtaaactccagaggcagcaagttctgtaggtttggccagatcttccttttcaaagacagacagcctggggaatcgtgcaaatggtcttccactgccctcttagattctttttatggcaaaatgctggcttttatcaattcctaccccaacctctgattcctacaggctggggaaagcaaacagcagttggggaagtgcatccaccttctcttgtgatggcaacaggagacttggacccctggggaggccaagaggaggggagtgaaaaggggtgagctgcaggagtggatgggggtgggtgggggaagaagctctggttgcagatacctgtgaaacttgtttttttttttttgcttgggtggagggatttggcctgggacccaaacagatggttgttcattctgaccccctaataggcatttctgcattaaatgatatcagagtggacacaggagaaagaaaagtctattgttgtgtccaccataaaaatagacgtgtggatgaaatgatcttggagcagaatcgactagagagggtgaacttgggcagaagaaatcaactcggacaagccagagtccctgacaaggtcgtgaggtctcaagccaatgggatgacataaaaaggtatttggatgccaataactgtaaccagcagcagatgcagctgctactggttcctcattgacacgtccacccttccttttcatccccagtgcagtccagccaagaaataaaggcaacttggaatcccaacagctggaagtgctgcagttccatatgtgtcaattgtctggaagcctctgggctgggaatacttactcctttgggaatgagaggaacacgagcagagcggggctttggaaatccgttcccagctagctgaacttggggccctctaggcttgaagtcaggacagcggtggcctggacatttccagggagtggcccacagggttgggtcattggccagatgctgctgtgtgccagggtctgagcccttgctcagaaaagagacaggcatggctttgcatggaactcaggtgtttggtcctctcccatgggagaggaccacaagcggcatcaaattccagcgaggcaaccgaagttgtcctcatcttccagacctgctcaaactttatagacatgaacgccaaagattatcccaccccgccaaaaaaaatgttggctctctccccattcatttcaggatggccttgtgcaagggactcccactgttagtttaaacacttcgttctctgcattcaatccagggattcattcatttggtcaaggtcagccacagtaaagtagaagtgttaacttatctgctatattagcattcacccaaatgagcagcttacttgctaccaagccaactattaataccttttggtttatagcaccaaggtacagcattgcagagaataagccaggagaaaatgtcctgacctttaaaagcttagggttccctggagaccccagtgacatatctcagcaaggagaagagatatcctggctgagtcctcaaccctgggtgtggccaaagacaagaaaatatggtttcatttggtctggggacagccatgccttggatacatggtaagaaatcttgactcctggaacatgcttgcacctttccttttaagaactgttttcatgccccagttataacagcttttatccaaaagacaggcaataacaaatgctggcaaggatgtggagaaaaggaaacattgcataccactggtgggaatgtaaattagtacaaccactatggagaacagtttggaggttcttcaaaacgcgaaaaatagagctaccatatggtccagcaatcccactgctgggtataatccccaagaagggaaattagtatatcaaagaaatatctgtactctcatgtttattgcagcactgttcacaacagccaagatttggaagtgacctaagggtacatgacgaatggataaagaaaatgttgtacataacacaatggagtactattcaaccataaaaagaatgagatcctataatttgcagcaacatagatggaactgaaggacattatgtcaagtgaaatagccaggaacagaaagacaaacttcacatgttctcacctacttgtgggagctaaaaatgaacaacaattgaactcacggagataaagaaagagagtaggttgatggttaccagaggctgggaagggtagtgggtggggcaggggggtgggtgcaggtgggaagtggggatggttaatggctacaaaaatgtagttagatagaataaataagatctagtatttgacagcaccataaggtgactaaagtcaacaataatttattgtacattcaaaaataactgcaagaggcaggcatggtggctcacacctgtaatcccagcactttgggaggcccaggtgggtggatcacctgaggtcaggagtttgagaccagtctgaccaacatggtgaaaccccatctctactaaaaatacaaaaattagctaggcgtggtagcagctgcctgtaatgccagctactcaggaggctgaggcaggagaatcacttgaacccgggaggcagaggttgcagtgagccaagatcgcaccattgcactccagcctgggcaacacagagagactctgtctcaaaacaaaacaaatcaaaacaaaacaaaactacaagagtacgattgaattgtttgtaatacaaagaaaggctaaatgcatgaggtgatgggtaccccatttaccctgatgtggttattatgcattgtatgcctgtataaaagtgtcttatgtaccccaaaaatatatatataactactgtgtatccacaattaagaaaaaagtcttcagtttgtagccacagcccagatgagtgctgtcccatctcctgctcttggaccagtgtgatctgaaaggatgacatccagtagatggaggaaggacccaacaagagaggctgcatcctctgatgatactaatggtattcctaagaatgaagaatcacagcttttactatctactaagtataaaacatgtgtgttacacacacaagcatgattccatctccttcccgtaacaacccatgggtgatgggaaactaaagcacacagactcaaagtaacttgcccaggttcacagtggcaggtgcagaactacagcccagcaccgaataatcaaaatgccaggctataaatatccagttgtcatcccaccgacatagcacagagctctgatacataagatggatatgggttgctctcctagagctgccgatggcattgagcacttctgaatatgtcacggatggccaccaactggacagctttcatgctgctggaattttaaagacagggccctgtgacagagaatccgaagagactgggaacaaccacaagctagagttgacttcagaaatgctgatgtgaatttccgactttagaacctcagtccttggccaaaaatgtcctcaattttttgacttcttgtacagtgggatttaaagagattagcaattaaattttataggagatttgtgtattattgttaaaatttcatcagaaattggcacctgccctttgaaatatgcacataaactattccctgaagtatgatttttcaagagtgttgttgaacaaaaatctttatctgtgggaatacctttctgaaattttaatggccatcaaatgggaatatatgattctctccacaaaaattccatttatacttctttgttttttttcaggatcacattaagtgaaatatgaccatatacagcaaagatgtcatgggtaggacccataagtgtatctgtatgcctgtgagggtgttggggtataagtttaccttgttttaaaattttaaaattaactatcagcatataaaatccaggagatagtacataaaaattcagatcgatggcttctcttgaaaacatggaatattttgaaccctgggtggacatgtgactgaagcttagtgcaagctggtcctttttatgggacatgtaccctgcaggttactgccacgcccagcatccttactcctgttgtgtttcatgaatttctatggcctgcctgtctccttagacatttgagtgtgtgacctccagtctacatgatagcaggtgcctccatgtgtggaaataagtctttcttggttcctttgttgatgtatttagtttctattggggctaaaacttaaggaagagcaattaaagacctctaagacagataggcagtcttccaaagactttccaataaaaataaatatcagccaggatctgtggcttatgtctgtaatcccagcacttgggagagcgaggcaggtggatcacttgagcccaggagtttgagaccagcctgggtaacaagatgaaacccagtctttacaaaaaatgcaaaaattagccggacatagtggcgcacacctgtaatcccagctacctcaggaggctgagaagggaggatcatctgagcctgggaggtcaaggctacagtgagccataatcacgccacggcactccaccctgggcaacagagtgagagactgtttcaaaaaaaaaaaaaaaaaaaaaaagtaaatgtcagagaatgtgtttgtctcctgaagtccctgcactagtgcacactgtacccattccacctgaattgccatggcagaccagacccttgctcagtttgtcatggccatgttctttgtgcttccctcattcttgcttacagtagacaactccctcccctcccctccccttcctttccctccatcatccaccttatcctcttccatcccggcctcatactttgcctcagggcaaggtctgtagtgttaagactgccgatggcctgagagaagaggccgatgaacccctggggctgctattagtatcggactttagacacattacaagttaaataggcttttgtgggctggcgggagatacaaccaccatgcgtgatactgtttctgggggagtatttcacccaggttccgaacaacagacttaaaatgaacttctgcaacatcatagcctattagtacattggattcttccaaattctagaagataattgggctttcttatttgcaacgtgttttcttagggcaagatctatatctgtctctctgtgctacgctgttgaagagcaataatacagatgcatttatggatcttaacaggagcgatcaactcaccaactatagctaagggcccaccgtgtgcaaagtactgggggaaaaatgtatagaaagctgccttgcaggagttcacaatacagtgtgcgtgttgggcacgaaggtggaaatggggcaaatagatggattactggcgattatgaatgatatcagagaaggccacagagattcagaaaatagcaggactagagacattcttatgaagaagatggtttggaatgaaagtgaaaaaataggtaatagttcaagaggcccttgccatcaatgacgtgggattccccaggcattccagacacagaacagagcaaagaacagcacaggagtgagaaagttcaaaggaaacttgggaaacagaggggaggctggtttgggtgaaatgtgacctgtacataagggagtgaaggaggatgaggctggaagagtgagttgggactgtgttggagagggctctgggcaccttgcggaaggactgccatgtaattgaccccaagacatagcaggcctgcgtgtggacagattggagggcagtgagaccagatgtggaaacagcacttagaagctcctacaattagcaaaaggcaatcagtagctctatgctgggggctggggtggaggagagaggcaatcgaagtgagaacattgtggttttggggaaatctcaagaactctcccagatcttggtgctgatgatgtcatttatctaacaatattattctgatacagtcactaaaccatccatccatctatccatccactgaacaagtatttgcatacctaggggcattgttcatgttatgcatttgatttggaaatttttctacacgtatgtaatgagttcaaggtcaaagactggagaaaccaaatgttctaagatgatttgcccaagtaaaaatgctctgcatattataaacaatgtttctcaaattgtgatcattggattattagaatgaaggatactttaagaaaacaaagattcaatattcaaagtttttatgcctcccttggtaaatcccaacacccatacaaatgatcaaaggccctgacaagtcctgcagttaaaaacaaaagtaaacaaaaaaactgtttaacctttcgcagttcacactttgaccacaggactcttttactgaataatatctactaaccttccaagaaacacattatgaaaaatattgttacaaagtagtatataaacttaaggcatagaccttcaagtgtagttactccttttaggttacctctagctccaaccattacctgaaaggtaaatgaaagggaccataattcagggtataacccacacagagataatttctaccttttaaccatttattgctgcatcacagattatcgaccacctactatgtgccaggcactatgtatggaattcacagtacagcagtcactaagagatgtttgtccctgtctgtaaagaactaaacttacagtttaatcagtaacaccaaatcttcactacaaggtgggacaaattggccactcgttctcctaccctcactttccctgtgattctccaacttatatttaccaaagcagttttattacagtgatatttcaaaagttctttatttaaaaagggtaattaagaggtaggatcccactgggggaaatgagaggccaagatgagagaattgcttgagcccagaagtttgagaccagcctgagcaacatagggagacccccatctctacaaaaatttaaaataatccaccaggcatgggggcacgtgcctatggtcccagctgcttgtgaggctgaggtgggaagaacttgagcctgggaggttgaggctgcagtgagctgtgattgcgccaccgcactttagactgggtgatagagtgagatcccgtctgaaacaaaacaaaacaaaacaagaggctggatcccaaaccagtacattcctctattagccagcagaggtgagaacagactagctaggaaaggagtttcacaagaactggctcgaataaccccagctggggacaaattttgattttcctcatctctggattcttctctctctttaacaaagaccactacccatgatcaattcctgggtgtctagcccaatccagcattcacagttcattcctgggagccaaagttcccttttgtagttccaaatgtttctctctcagttttttattttatttttttaaaataatgaccgatgttctaaaatcagctagcaagataggcaaaataatcagtaatttctaattgtatatttaaaatatcaatacgaagtggttctgggctgcaaaccagaagaaacagacttggcttataagacattaagaaaatttttagtcttgaggtctgcatgttttgtgagctttatatagaggataaaagtgaaacttcagcttttaagccatgctgttaaaaattatatttacatccagtataattctgcaaccattaagccttaaatgggtattaagcctgattcaaagtaatgaaacagatggtggaaacacacactatggattcttcaatctggggagaaaagggctgattcatctgtttcaagggccaggcaaagataaaagacttcatcccaaatggagctgcttcctcctcaaaccttagcattccctccaatgtatttctccgtgtggaaagtattattaatgtcagtatccccagtgcttgtaaaagattcataggccatttcctccccttactgaattcccctgtctgtcccgtcaccgccccatgttcgttcatctcactgttgggcagtttggtgacgccagttgcagattccatcacaacccagctgcctgtcataggatcacagcattttagagctggaaggggcttagagatggcattttcagaagagaaaatggggctgggcacagtggctcatgcctgtaatcccagcactttgggaggccaaggttggtggatcacctgaggtcaggagttcaagactagcctggccaacatggtgaaaccccatctctactaaaaatacaaaaattagctgagtgaggtgatgggcacctgtaatcccagctactcgggaggctggggcaggagaatcgcttgaacccgggaggtggaggttgtgctgagccgagagataatgccattgcactccagcctggacaacaagagcaagactccatctcaaaaaaaaaaaaaaaacaaaaaacggaaaacaaacaaacaaaaaacagagagaaaacagaagctcaaaggacagtgacttgttcaaagtcacacagtgagcacagactgggatcactgtaggcatttttattcctttgcttgtcttctttctcctcttctttcccacttctgaaaatatttacagaatcctttatagggaccagggtgggaaattaggagaaattctacaaggtgagaataaaaatgttgtagacagtcagcccaaaggttgtgggagtgctgatgaataaaggtagatggaatgggaggactagaaaaccagtattggactcattcattatgaaaattaatttctaactttagggggaacatggaaaagtccctgtgaggataccacagtcataaatgtcgtaggcaagaccggtgctgccaggggtactcaatttagcagacgaaagttgagaagtcggccggacgcggtggctcacgcctgtaatcccagcactttgggaggccgaggcgggtggaccacgaggtcaggagatcgagaccatcctggctaacatggtgaaacccccgtctctactaaaaatacaaaaaattagccgggtgcggtggcgggcgcctgtagtcccagctaccagggaggctgaagcaggagaatggcgtgaactcgggaggcggagcctgcagtgagccgagatcgcgccactgcactccagcctgggcgacagagcgagactccgtctcaaacagaaaaaaaagcaagttgaggagtaggatattatcatcatctcaacgtacctcccaaaatatacttaacagtttcaaagggaaaaacagtaactttgcggcatgaaaacctggcagataccaccttacccaagtgaccaaagggactatcagttataagccaaactgacatcacgcaccccgcatataataccctgagaagggcacgtcacctctgctattgctgcccaaaacatacgcatgtcttcgatcaaatcatgagaaccttcctatacattctatccagtcatggagcaatactttttcaagtgtccaggtgtgaaaaacaagggaggactgagaggctgtcatagattaagggagctgaaggaaacacagctaaaagctgtcttacatttaggattgtggataggatccaagaaacaggacgtgagtgaaaacaccggtgaaatccaaatacaatctatactttggtattagtattgtacccattaattaagaaaaggaattttttcttttcttttttttttttttttttggagacagggtcttgctatgtcgcccagtttgtcttcaaactcctgggctcaagtgatcctcctgcctcagcctcctgagtacctaggattccaagtatgcaccaccatgcccagccgatttcctaattttgatagttgcaccacagttatctaggatttttatcattggggaagttgggtgaggaatacacagaaactctctgaacaatttttgcaaattttttgttgtctaaaataatttaaaaataattttttaaaaaggaaaaagaggctgggtgcggtggctcacgcctgtaatcccagtactagtactttgggaggctgaagcgggtggatcacgaggttgggatatcgagaccatcctggctaacacagtgaaaccccgtctctataaaaaataaaaaataaataaaaaaataaaaaattagccgggcatggtggcaggcgcctgtagtcccagctcctcgggaggctgaggcatgagaatggcgtgaacccaggaggcggagcttgcagtgagctgagatcgcgccactgcactccagcctgggcaacagagcgagactccatctcaaaaaaaaaaaaaaaaaaaaaaaaggaaaaagaaaaggctgtgggatgcaaggaaagacagtaagtcatgggatggagctataaagcacagcagctgaccattccttctagaaccttctaaatcctaaaagatggacagaggccactgggaactcgctatttcccttttgggttaatcagaacttgtacgttattatagccataacattcacaagttagataaacttctgagaataagccccagggcgtggaagggattaaggaagagtccgatttcctcatcagttgcagctggtagacggtggtaccaggacttctgttgagtgactttggggcagccgccctacaggctcaactcccagaagctacctggcccgatcacctggaatagggagtccccctgtcacgggaaaggatgagaagtgggtacccagggaaggagtggtggggggaagaggacatctttgttcaggctgtgtttgttctacatagtgtgtatatgtttctgacaatgaaatgtgttcttggaaatgtccccttcatttatagatgtatcactgcagagtatgtgtgagaaaaagaaagagacatgtcagaatcccacagacaacagcttagccctgccttccattatatatacaaagtgttgtgtacgttagtgatacatttgcagaaggggtgggaatgtggctttgtccgtatttccaaatgtaaaacaggtctcccatcccctctgtttggttgtggctgtttccttacagaatgaaaatactggcattggaggcactgttgccagaaacttgcttggcaaaacatttacattcctttgtacatatatataaacaaaatcacttcttccaatggatactttttcacgtcctccctgatttctgtggtaataatgaccacatttggctccaaacctggggatgtggtagagaaagccacctcccaattccagatcctgaaatctcgtggaagattaacatggacgtcaaactgacgttaccaatttaagggatttaaacactcagctctagagtaaacaaaatccagtggcaaggttttggacaacttcagcgacgtttgacaacacaacccagatgttggggagtgcaaaccttgtaaacgtaggctttccactgtgttctgtacaagcaagatgttgagtgagacagaccggctaatgaaggaaagaagtactgataattattgagtgacttttatggggcagatagtatgctaagtgcgccatagacactgtctcactcaccatttgcaatgaggtagctattatttattgatatggacatgaggctcagaaatctgcaatttgcctcacttggcaagtgacaacatcagtatttgactcatgtgagtgtgactttaaaacctttgctatttccagaagtcaacactgactgtatgtaacattcctttgcttaaaacctcccagtttctctcactgccactagatcagtgactgtctcagctcagcctttgatgccttggtggtggcccctgctgccccacagaactaaaagctatttacgtaaggctggggctctcttaaaaatgtggttccctcagtcttcccacctttgctagcatttactatatgccatatgattttttttttgagatggggtctcgctatgttgcccaggctggacttgaactgctgagctcaagccatcctcccacctgcctcagcctctcaaatagctgggatcataggtgcgcccctccgtgcccagctttggctatgtgatttcttcattcacaagtctgcctgggactccttgtccataagggtgttgatactttttgaatctaatgatactatgtgcttagtggttaatacctgcttcttgctgagtgaatgaatgagaattaacatatatatatatagatagataatttttttttttttctggagacagggtctcactctgtcacccaggctggagtccagaggcgtgatcacagatcactgaagtctcgacctcctgagctcaagtaatcctcccacctcagtcttccaagtacctgggactaaaggcatgcaccactactcctggctaattttttgtactttttctagggacagcgtttcactatgttgtccaggcttgtttcaaactcctgggctcaagccatcagcctgcctcaacctcctaaagtgctgacattacaggcatgagccactgtgcccagccaggaaatgtttcaaatacttgaggtaataaatatttttaaattttatataagattctgtgtaagtgctatgaatgttacaactcattgtgaataatttactaaagcagaattcctaaagattcatattagatagtatctaatggttttatttcagtggttctgagctggggttattttgacacccctgcccaggggacatctggcaacgtcttgagacatgtgggttatcaccactgcagggaaggcggcgtcgctggcattatcgggtagatgccagggattctgctaagcatcctacaatgccctagaaactccctccaatgccagtcctcccaaacaaagcgcatattgccaagacggaataaccctgctttgtttgatgtaatgacatggcatatacttgaaggcagtcaaactacggttcatttgtttttttgttttatttcagatttttgatgaaccaagctggctggtgtcgcctcagtttgtctaaattaccaaggaccgctggaatttccctgggaatatgtttcgggaaaggtcagaaactcttcagtcgtcttcacgcttccactcagtagcaacgtttttgcacactcattgactatcaactggttgtctatgactcaaattacataatgaatccagcacataaattatttactcagatttaatgccagcaactgttatctttgtatttttttcccctctgccagctaatctggctcatttcattggaattttggtcatgcccattctccttctgcactaaattaactccataacgtagtataaacagaacaagcttgtgtgtgatatgcttaactgttaatttacctaattaaactaattcaattaaatcatttacatctttttggtaacatgccagttgataccacagcagaagtgggatgtttcagaagatgattgttcagcaaatgaatggaaaaaaaaataaaaggaaaacaaaatgagacaaccgtccaaatctcttggcttgaaaattaaatgatactgaaaaaatgcagctttcacggggcactgtgattagatatttttctgaaatcaattttctctacaaattggtattttaacagagtgatcacaatctattgtacaaaatattttaaacactatttgtacattcacatatttggtatgtttaagtaaagtgtgcttgttcccaca
